US009187746B2

(12) United States Patent
Fitzgerald et al.

(10) Patent No.: US 9,187,746 B2
(45) Date of Patent: Nov. 17, 2015

(54) DUAL TARGETING SIRNA AGENTS

(75) Inventors: Kevin Fitzgerald, Brookline, MA (US); Maria Frank-Kamenetsky, Brookline, MA (US); Klaus Charisse, Acton, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 246 days.

(21) Appl. No.: 13/497,226

(22) PCT Filed: Sep. 22, 2010

(86) PCT No.: PCT/US2010/049868
§ 371 (c)(1),
(2), (4) Date: Oct. 10, 2012

(87) PCT Pub. No.: WO2011/038031
PCT Pub. Date: Mar. 31, 2011

(65) Prior Publication Data
US 2013/0184324 A1    Jul. 18, 2013

Related U.S. Application Data

(60) Provisional application No. 61/244,859, filed on Sep. 22, 2009, provisional application No. 61/313,584, filed on Mar. 12, 2010.

(51) Int. Cl.
| | | |
|---|---|---|
| A61K 31/70 | (2006.01) |
| C07H 21/02 | (2006.01) |
| C07H 21/04 | (2006.01) |
| C12N 15/113 | (2010.01) |
| A61K 31/713 | (2006.01) |
| C12Q 1/68 | (2006.01) |

(52) U.S. Cl.
CPC ............ *C12N 15/113* (2013.01); *A61K 31/713* (2013.01); *C07H 21/02* (2013.01); *C12N 15/1137* (2013.01); *C12Y 304/21061* (2013.01); *C12N 2310/14* (2013.01); *C12N 2310/321* (2013.01); *C12N 2310/322* (2013.01); *C12N 2310/3519* (2013.01)

(58) Field of Classification Search
None
See application file for complete search history.

(56) References Cited

U.S. PATENT DOCUMENTS

| | | |
|---|---|---|
| 7,427,605 B2 | 9/2008 | Davis et al. |
| 7,605,251 B2 | 10/2009 | Tan et al. |
| 7,718,629 B2 | 5/2010 | Bumcrot et al. |
| 7,875,711 B2 | 1/2011 | Fitzgerald et al. |
| 8,222,222 B2 | 7/2012 | Tan et al. |
| 8,273,869 B2 | 9/2012 | Fitzgerald et al. |
| 2003/0143732 A1 | 7/2003 | Fosnaugh et al. |
| 2003/0170891 A1 | 9/2003 | McSwiggen |
| 2003/0229037 A1 | 12/2003 | Massing et al. |
| 2004/0259247 A1 | 12/2004 | Tuschl et al. |
| 2006/0003322 A1 | 1/2006 | Bentwich et al. |
| 2006/0008910 A1 | 1/2006 | MacLachlan et al. |
| 2006/0083780 A1 | 4/2006 | Heyes et al. |
| 2006/0240093 A1 | 10/2006 | MacLachlan et al. |
| 2006/0263435 A1 | 11/2006 | Davis et al. |
| 2007/0004664 A1 | 1/2007 | McSwiggen et al. |
| 2007/0031844 A1 | 2/2007 | Khvorova et al. |
| 2007/0135372 A1 | 6/2007 | MacLachlan et al. |
| 2007/0173473 A1 | 7/2007 | McSwiggen et al. |
| 2007/0275914 A1 | 11/2007 | Manoharan et al. |
| 2007/0281899 A1 | 12/2007 | Bumcrot et al. |
| 2008/0113930 A1 | 5/2008 | Tan et al. |
| 2008/0188675 A1 | 8/2008 | Chen et al. |
| 2009/0023215 A1 | 1/2009 | Jessee et al. |
| 2009/0023673 A1 | 1/2009 | Manoharan et al. |
| 2009/0093426 A1 | 4/2009 | Soutschek et al. |
| 2009/0149403 A1 | 6/2009 | MacLachlan |
| 2009/0232738 A1 | 9/2009 | Glimcher et al. |
| 2009/0275638 A1 | 11/2009 | Fitzgerald et al. |
| 2009/0291131 A1 | 11/2009 | MacLachlan et al. |
| 2010/0010066 A1 | 1/2010 | Fitzgerald et al. |
| 2010/0130588 A1 | 5/2010 | Yaworski |
| 2010/0324120 A1 | 12/2010 | Chen et al. |
| 2011/0015250 A1 | 1/2011 | Bumcrot et al. |
| 2011/0015252 A1 | 1/2011 | Fitzgerald et al. |
| 2011/0152350 A1 | 6/2011 | Fitzgerald et al. |
| 2011/0230542 A1 | 9/2011 | Tan et al. |
| 2012/0016009 A1 | 1/2012 | Fitzgerald et al. |
| 2012/0244207 A1 | 9/2012 | Fitzgerald et al. |

FOREIGN PATENT DOCUMENTS

| | | |
|---|---|---|
| WO | WO 03/070918 A | 8/2003 |
| WO | WO 2004/080406 | 9/2004 |
| WO | WO 2004/090108 | 10/2004 |
| WO | WO 2005/014782 A | 2/2005 |
| WO | WO 2005/120152 | 12/2005 |
| WO | WO 2007/012191 | 2/2007 |

(Continued)

OTHER PUBLICATIONS

Agrawal, S., et al., "Antisense oligonucleotides: towards clinical trials." Trends in Biotechnology. Oct. 1996, vol. 14, pp. 376-387.
Bass, B., "The short answer," Nature, May 24, 2001, pp. 428-429, vol. 411.
Elbashir, S., et al., "Analysis of gene function in somatic mammalian cells using small interfering RNAs," Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in *Drosophila melanogaster* Embryo Lysate", The EMBO Journal, 2001, pp. 6877-6888, vol. 20, No. 23.

(Continued)

*Primary Examiner* — Sean McGarry
(74) *Attorney, Agent, or Firm* — Fenwick & West LLP

(57) ABSTRACT

The invention relates to dual targeting siRNA agents targeting a PCSK9 gene and a second gene, and methods of using dual targeting siRNA agents to inhibit expression of PCSK.9 and to treat PCSK.9 related disorders, e.g., hyperlipidemia.

20 Claims, 6 Drawing Sheets

(56) References Cited

FOREIGN PATENT DOCUMENTS

| WO | WO 2007/091269 | 8/2007 |
|---|---|---|
| WO | WO 2007/134161 | 11/2007 |
| WO | WO 2008/011431 A2 | 1/2008 |
| WO | WO 2008/042973 | 4/2008 |
| WO | WO 2009/086558 | 7/2009 |
| WO | WO 2009/127060 | 10/2009 |
| WO | WO 2009/129465 | 10/2009 |
| WO | WO 2009/134487 | 11/2009 |
| WO | WO 2010/054406 | 5/2010 |
| WO | WO 2010/088537 | 8/2010 |
| WO | WO 2010/099341 | 9/2010 |
| WO | WO 2010/129709 | 11/2010 |
| WO | WO 2010/144740 | 12/2010 |
| WO | WO 2010/147992 | 12/2010 |
| WO | WO 2010/148013 | 12/2010 |
| WO | WO 2011/028938 | 3/2011 |

OTHER PUBLICATIONS

Elbashir, S., et al., "RNA Interference is Mediated by 21-and 22 Nucleotide RNAs," Genes & Development, 2001, pp. 188-200, vol. 15.

Fire, A., "RNA-triggered Gene Silencing," Trends in Genetics, Sep. 1999, pp. 358-363, vol. 15, No. 9.

Fire, A., et al., "Potent and Specific Genetic Interference by Double Stranded RNA in Caenorhabditis elegans," Nature, Feb. 19, 1998, pp. 806-811, vol. 391.

Love, K., et al., "Lipid-like materials for low-dose, in vivo gene silencing," PNAS, Feb. 2, 2010, pp. 1864-1869, vol. 107, No. 5.

Patent Cooperation Treaty, International Search Report and Written Opinion, International Patent Application No. PCT/US2010/049868, Jan. 31, 2011, 15 pages.

Reynolds, et al. (2004) "Rational siRNA design for RNA interference," Nature Biotechnology, vol. 22, No. 3, pp. 326-330.

Robbins, M., et al., "Stable expression of shRNAs in human CD34+ progenitor cells can avoid induction of interferon responses to siRNAs in vitro," Nature Biotechnology, May 2006, pp. 566-571, vol. 24, No. 5.

Rose, S., et al., "Functional polarity is introduced by Dicer processing of short substrate RNAs," Nucleic Acids Research, 2005, pp. 4140-4156, vol. 33, No. 13.

Tuschl, T., "Functional genomics: RNA sets the standard," Nature, Jan. 16, 2003, vol. 421, No. 6920, pp. 220-221.

Tuschl T., "RNA Interference and Small Interfering RNAs" Chembiochem, 2001, pp. 239-245, vol. 2.

Tuschl, T., et al., "Small Interfering RNAs: A Revolutionary Tool for the Analysis of Gene Function and Gene Therapy," Molecular Interventions, 2002, pp. 158-167, vol. 2, No. 3.

Tuschl, T., "Mammalian RNA Interference," RNAi, A Guide to Gene Silencing, Chapter 13, G.J. Hannon (ed,), 2003, pp. 265-295.

Tuschl, T., et al., "Targeted mRNA Degradation by Double-Stranded RNA in Vitro," Genes & Development, 1999, pp. 3191-3197, vol. 13.

Tuschl, T., "Expanding small RNA interference," Nature Biotechnology, May 2002, pp. 446-448, vol. 20.

Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.

Weil, et al (2002) "Targeting the Kinesin Eg5 to Monitor siRNA Transfection in Mammalian Cells," *Biotechniques* 33(6):1244-1248.

Zimmerman, et al. (2006) "RNAi-mediated gene silencing in non-human primates," *Nature*, vol. 441, May 4: 111-114.

Hornung, V., et al., "Sequence-specific potent induction of IFN-α by short interfering RNA in plasmacytoid dendritic cells throughTLR7," Nature Medicine, Mar. 2005, pp. 263-270, vol. 11, No. 3.

European Search Report for European Patent Application No. EP 12178667, Mar. 26, 2013, 9 Pages.

Benjannet, S., et al., "NARC-1/PCSK9 and its natural mutants: zymogen cleavage and effects on the low density lipoprotein (LDL) receptor and LDL cholesterol," Journal of Biological Chemistry, Nov. 19, 2004, pp. 48865-48875, vol. 279, No. 47.

Harborth, J., et al., "Sequence, chemical, and structural variation of small interfering RNAs and short hairpin RNAs and the effect on mammalian gene silencing," Antisense & Nucleic Acid Drug Development, Apr. 1, 2003, pp. 83-105, vol. 13, No. 2.

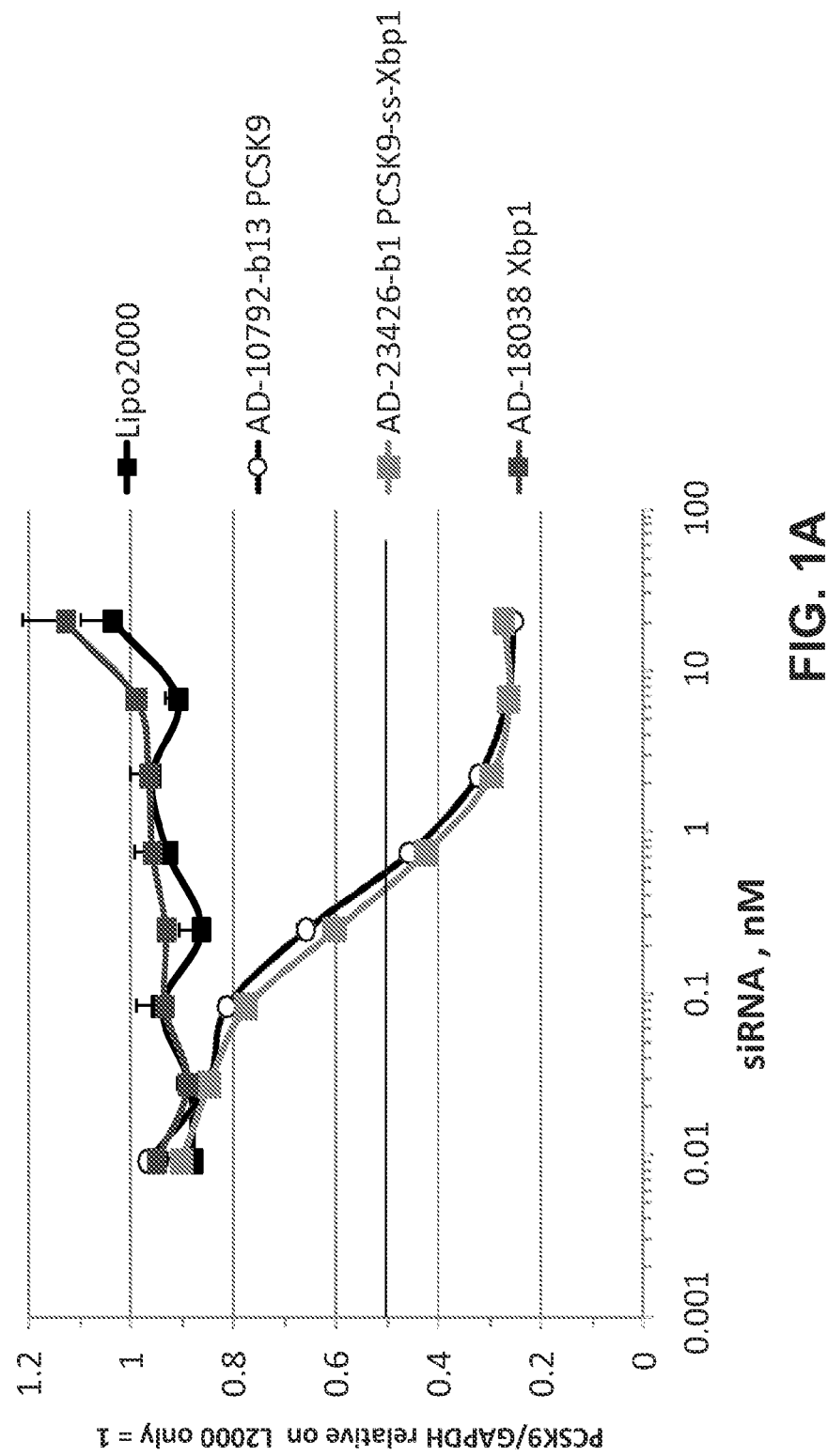

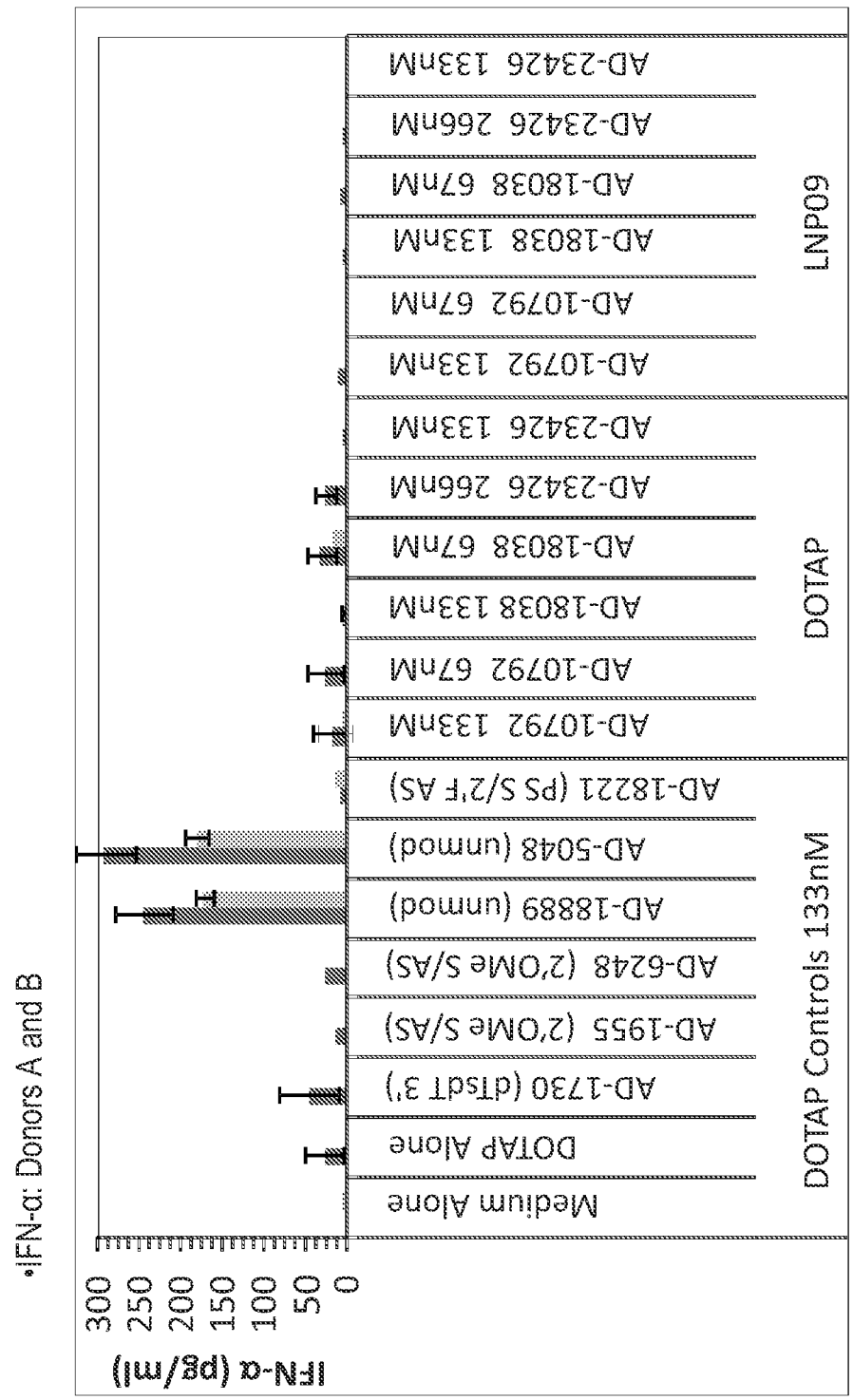

DUAL TARGETING SIRNA AGENTS

CROSS REFERENCE TO RELATED APPLICATIONS

This application claims the benefit of U.S. Provisional Application No. 61/244,859, filed Sep. 22, 2009, which is hereby incorporated in its entirety by reference, and claims the benefit of U.S. Provisional Application No. 61/313,584, filed Mar. 12, 2010, which is hereby incorporated in its entirety by reference.

REFERENCE TO A SEQUENCE LISTING

This application includes a Sequence Listing submitted electronically as a text file named 17187US_sequencelisting.txt, created on Oct. 12, 2010, with a size of 1,350,742 bytes. The sequence listing is incorporated by reference.

FIELD OF THE INVENTION

The invention relates to a composition of two covalently linked siRNAs, e.g., a dual targeting siRNA agent. At least one siRNA is a dsRNA that targets a PCSK9 gene. The covalently linked siRNA agent is used in methods of inhibition of PCSK9 gene expression and methods of treatment of pathological conditions associated with PCSK9 gene expression, e.g., hyperlipidemia.

BACKGROUND OF THE INVENTION

Proprotein convertase subtilisin kexin 9 (PCSK9) is a member of the subtilisin serine protease family. The other eight mammalian subtilisin proteases, PCSK1-PCSK8 (also called PC1/3, PC2, furin, PC4, PC5/6, PACE4, PC7, and S1P/SKI-1) are proprotein convertases that process a wide variety of proteins in the secretory pathway and play roles in diverse biological processes (Bergeron. F. (2000) *J. Mol. Endocrinol.* 24, 1-22, Gensberg, K., (1998) *Semin. Cell Dev. Biol.* 9, 11-17, Seidah, N. G. (1999) *Brain Res.* 848, 45-62, Taylor, N. A., (2003) *FASEB J.* 17, 1215-1227, and Zhou, A., (1999) *J. Biol. Chem.* 274, 20745-20748). PCSK9 has been proposed to play a role in cholesterol metabolism. PCSK9 mRNA expression is down-regulated by dietary cholesterol feeding in mice (Maxwell, K. N., (2003) *J. Lipid Res.* 44, 2109-2119), up-regulated by statins in HepG2 cells (Dubuc, G., (2004) *Arterioscler. Thromb. Vasc. Biol.* 24, 1454-1459), and up-regulated in sterol regulatory element binding protein (SREBP) transgenic mice (Horton, J. D., (2003) *Proc. Natl. Acad. Sci. USA* 100, 12027-12032), similar to the cholesterol biosynthetic enzymes and the low-density lipoprotein receptor (LDLR). Furthermore. PCSK9 missense mutations have been found to be associated with a form of autosomal dominant hypercholesterolemia (Hchola3) (Abifadel, M., et al. (2003) *Nat. Genet.* 34, 154-156, Timms, K. M., (2004) *Hum. Genet.* 114, 349-353, Leren, T. P. (2004) *Clin. Genet.* 65, 419-422). PCSK9 may also play a role in determining LDL cholesterol levels in the general population, because single-nucleotide polymorphisms (SNPs) have been associated with cholesterol levels in a Japanese population (Shioji, K., (2004) *J. Hum. Genet.* 49, 109-114).

Autosomal dominant hypercholesterolemias (ADHs) are monogenic diseases in which patients exhibit elevated total and LDL cholesterol levels, tendon xanthomas, and premature atherosclerosis (Rader, D. J., (2003) *J. Clin. Invest.* 111, 1795-1803). The pathogenesis of ADHs and a recessive form, autosomal recessive hypercholesterolemia (ARH) (Cohen, J. C., (2003) *Curr. Opin. Lipidol.* 14, 121-127), is due to defects in LDL uptake by the liver. ADH may be caused by LDLR mutations, which prevent LDL uptake, or by mutations in the protein on LDL, apolipoprotein B, which binds to the LDLR. ARH is caused by mutations in the ARH protein that are necessary for endocytosis of the LDLR-LDL complex via its interaction with clathrin. Therefore, if PCSK9 mutations are causative in Hchola3 families, it seems likely that PCSK9 plays a role in receptor-mediated LDL uptake.

Overexpression studies point to a role for PCSK9 in controlling LDLR levels and, hence, LDL uptake by the liver (Maxwell, K. N. (2004) *Proc. Natl. Acad. Sci. USA* 101, 7100-7105, Benjannet, S., et al. (2004) *J. Biol. Chem.* 279, 48865-48875, Park, S. W., (2004) *J. Biol. Chem.* 279, 50630-50638). Adenoviral-mediated overexpression of mouse or human PCSK9 for 3 or 4 days in mice results in elevated total and LDL cholesterol levels; this effect is not seen in LDLR knockout animals (Maxwell, K. N. (2004) *Proc. Natl. Acad. Sci. USA* 101, 7100-7105, Benjannet, S., et al. (2004) *J. Biol. Chem.* 279, 48865-48875, Park, S. W., (2004) *J. Biol. Chem.* 279, 50630-50638). In addition. PCSK9 overexpression results in a severe reduction in hepatic LDLR protein, without affecting LDLR mRNA levels, SREBP protein levels, or SREBP protein nuclear to cytoplasmic ratio.

Loss of function mutations in PCSK9 have been designed in mouse models (Rashid et al., (2005) *PNAS,* 102, 5374-5379), and identified in human individuals (Cohen et al. (2005) *Nature Genetics* 37:161-165). In both cases loss of PCSK9 function lead to lowering of total and LDLc cholesterol. In a retrospective outcome study over 15 years, loss of one copy of PCSK9 was shown to shift LDLc levels lower and to lead to an increased risk-benefit protection from developing cardiovascular heart disease (Cohen et al., (2006) *N. Engl. J. Med.,* 354:1264-1272).

X-box binding protein 1 (XBP-1) is a basic leucine zipper transcription factor that is involved in the cellular unfolded protein response (UPR). XBP-1 is known to be active in the endoplasmic reticulum (ER). The ER consists of a system of folded membranes and tubules in the cytoplasm of cells. Proteins and lipids are manufactured and processed in the ER. When unusual demands are placed on the ER, "ER stress" occurs. ER stress can be triggered by a viral infection, gene mutations, exposure to toxins, aggregation of improperly folded proteins or a shortage of intracellular nutrients. The result can be Type II diabetes, metabolic syndrome, a neurological disorder or cancer.

Two XBP-1 isoforms are known to exist in cells: spliced XBP-1S and unspliced XBP-1U. Both isoforms of XBP-1 bind to the 21-bp Tax-responsive element of the human T-lymphotropic virus type 1 (HTLV-1) long terminal repeat (LTR) in vitro and transactivate HTLV-1 transcription. HTLV-1 is associated with a rare form of blood dyscrasia known as Adult T-cell Leukemia/lymphoma (ATLL) and a myelopathy, tropical spastic paresis.

Double-stranded RNA molecules (dsRNA) have been shown to block gene expression in a highly conserved regulatory mechanism known as RNA interference (RNAi). WO 99/32619 (Fire et al.) disclosed the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., *Curr. Biol.* (2000) 10:1191-1200), and mammals (see WO 00/44895, Limmer; and DE 101 00 586.5, Kreutzer et al.). This natural mechanism has now become the focus for the development of a new class of pharmaceutical agents for treating disorders that are caused by the aberrant or unwanted regulation of a gene.

A description of siRNA targeting PCSK9 can be found in U.S. patent application Ser. No. 11/746,864 filed on May 10, 2007 (now U.S. Pat. No. 7,605,251) and International Patent Application No. PCT/US2007/068655 filed May 10, 2007 (published as WO 2007/134161). Additional disclosure can be found in U.S. patent application Ser. No. 12/478,452 filed Jun. 4, 2009 (published as US 2010/0010066) and International Patent Application No. PCT/US2009/032743 filed Jan. 30, 2009 (published as WO 2009/134487).

A description of siRNA targeting XPB-1 can be found in U.S. patent application Ser. No. 12/425,811 filed on Apr. 17, 2009 and published as US 2009-0275638.

Dual targeting siRNAs can be found in International patent application publication no. WO/2007/091269.

SUMMARY OF THE INVENTION

Described herein are dual targeting siRNA agent in which a first siRNA targeting PCSK9 is covalently joined to a second siRNA targeting a gene implicated in cholesterol metabolism, e.g., XBP-1. The two siRNAs are covalently linked via, e.g., a disulfide linker.

Accordingly one aspect of the invention is a dual targeting siRNA agent having a first dsRNA targeting a PCSK9 gene and a second dsRNA targeting a second gene, wherein the first dsRNA and the second dsRNA are linked with a covalent linker. The second gene is can be, e.g., XBP-1, PCSK9, PCSK5, ApoC3, SCAP, or MIG12. In one embodiment, the second gene is XBP-1. Each dsRNA is 30 nucleotides or less in length. In general, each strand of each dsRNA is 19-23 bases in length.

In one embodiment, the dual targeting siRNA agent comprising a first dsRNA AD-10792 targeting a PCSK9 gene and a second dsRNA AD-18038 targeting an XBP-1 gene, wherein AD-10792 sense strand and AD-18038 sense strand are covalently linked with a disulfide linker.

The first dsRNA of the dual targeting siRNA agent targets a PCSK9 gene. In one aspect, the first dsRNA includes at least 15 contiguous nucleotides of an antisense strand of one of Tables 1, 2, or 4-8, or includes an antisense strand of one of Tables 1, 2, or 4-8, or includes a sense strand and an antisense strand of one of Tables 1, 2, or 4-8. The first dsRNA can be AD-9680 or AD-10792.

In some embodiments, the second dsRNA target XBP-1. In one aspect, the second dsRNA includes at least 15 contiguous nucleotides of an antisense strand of one of Tables 3 or 9-13, or includes an antisense strand of one of Tables 3 or 9-13, or includes a sense strand and an antisense strand of one of Tables 3 or 9-13. For example, the second dsRNA can be AD-18038.

Either the first and second dsRNA can include at least one modified nucleotide, e.g., a 2'-O-methyl modified nucleotide, a nucleotide comprising a 5'-phosphorothioate group, a terminal nucleotide linked to a cholesteryl derivative or dodecanoic acid bisdecylamide group, a 2'-deoxy-2'-fluoro modified nucleotide, a 2'-deoxy-modified nucleotide, a locked nucleotide, an abasic nucleotide, a 2'-amino-modified nucleotide, a 2'-alkyl-modified nucleotide, a morpholino nucleotide, a phosphoramidate, and a non-natural base comprising nucleotide. In some embodiments, the first and second dsRNAs include "endo-light" modification with 2'-O-methyl modified nucleotides and nucleotides comprising a 5'-phosphorothioate group.

The first and second dsRNAs are linked with a covalent linker. In some embodiments, the linker is a disulfide linker.

Various combinations of strands can be linked, e.g., the first and second dsRNA sense strands are covalently linked or, e.g., the first and second dsRNA antisense strands are covalently linked. In some embodiments, any of the dual targeting siRNA agents of the invention include a ligand.

Also included in the invention are isolated cells having and vectors encoding the dual targeting siRNA agent described herein.

In one aspect, administration of the dual targeting siRNA agent to a cell inhibits expression of the PCSK9 gene and the second gene at a level equivalent to inhibition of expression of both genes using administration of each siRNA individually. In another aspect, administration of the dual targeting siRNA agent to a subject results in a greater reduction of total serum cholesterol that that obtained by administration of each siRNA alone.

The invention also includes a pharmaceutical composition comprising the dual targeting siRNA agents described herein and a pharmaceutical carrier. In one embodiment, the pharmaceutical carrier is a lipid formulation, e.g., a lipid formulation including cationic lipid DLinDMA or cationic lipid XTC. Examples of lipid formulations described in (but not limited to) Table A, below. The lipid formulation can be XTC/DSPC/Cholesterol/PEG-DMG at % mol ratios of 50/10/38.5/1.5.

Another aspect of the invention includes methods of using the dual targeting siRNA agents described herein. In one embodiment, the invention is a method of inhibiting expression of the PCSK9 gene and a second gene in a cell, the method comprising (a) introducing into the cell the any of the dual targeting siRNA agents and (b) maintaining the cell produced in step (a) for a time sufficient to obtain degradation of the mRNA transcript of the PCSK9 gene and the second gene, thereby inhibiting expression of the PCSK9 gene and the second gene in the cell.

In another embodiment, the invention includes methods of treating a disorder mediated by PCSK9 expression with the step of administering to a subject in need of such treatment a therapeutically effective amount of the pharmaceutical compositions described herein. In one aspect, the disorder is hyperlipidemia. In still another embodiment, the invention includes methods of reducing total serum cholesterol in a subject comprising administering to the subject a therapeutically effective amount of the pharmaceutical compositions described herein.

The details of various embodiments of the invention are set forth in the description below. Other features, objects, and advantages of the invention will be apparent from the description and the drawings, and from the claims.

DESCRIPTION OF THE DRAWINGS

FIG. 1 is a graph showing the effect on PCSK9 and XBP-1 mRNA levels in primary mouse hepatocytes following treatment with a dual targeting siRNA, AD-23426. AD-23426 was as effective at reducing mRNA expression as each single gene target siRNA. FIG. 1A: PCSK9 mRNA levels.

DETAILED DESCRIPTION OF THE INVENTION

Figure 1B:
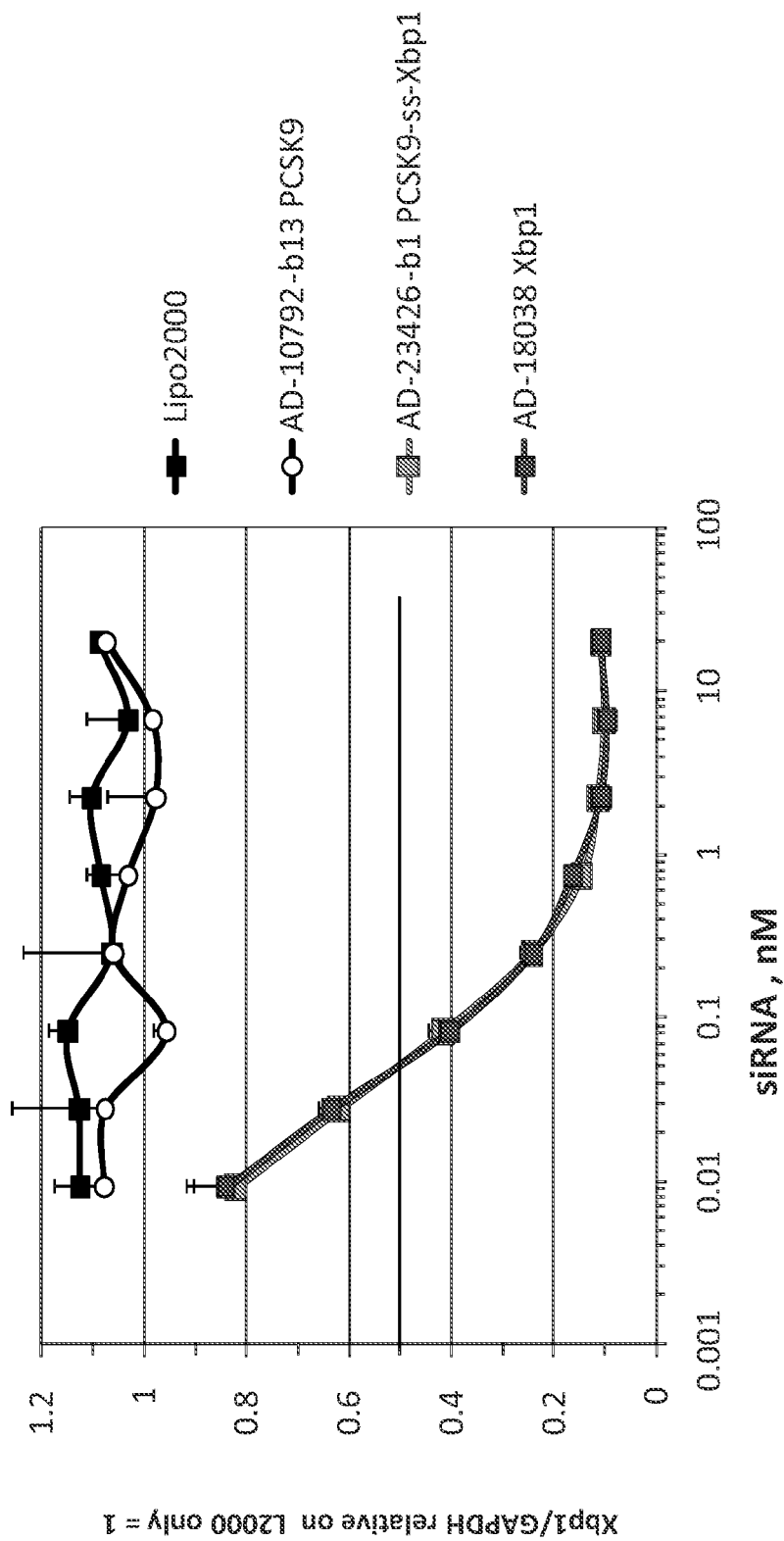
FIG. 1B: XBP-1 mRNA levels. AD-10792: PCSK9 siRNA. AD-18038: XBP-1 siRNA. Lipo2000: control transfection agent only.

The invention provides a solution to the problem of treating diseases that can be modulated by the down regulation of the PCSK9 gene, such as hyperlipidemia, by using dual targeting siRNA to silence the PCSK9 gene.

The invention provides compositions and methods for inhibiting the expression of the PCSK9 gene in a subject using two siRNA, e.g., a dual targeting siRNA. The invention also provides compositions and methods for treating pathological conditions and diseases, such as hyperlipidemia, that can be modulated by down regulating the expression of the PCSK9 gene.

The dual targeting siRNA agents target a PCSK9 gene and at least one other gene. The other gene can be another region of the PCSK9 gene, or can be another gene, e.g., XBP-1.

The dual targeting siRNA agents have the advantage of lower toxicity, lower off-target effects, and lower effective concentration compared to individual siRNAs.

The use of the dual targeting siRNA dsRNAs enables the targeted degradation of an mRNA that is involved in the regulation of the LDL receptor and circulating cholesterol levels. Using cell-based and animal assays it was demonstrated that inhibiting both a PCSK9 gene and an XBP-1 gene using a dual targeting siRNA is at least as effective at inhibiting their corresponding targets as the use of single siRNAs. It was also demonstrated that administration of a dual targeting siRNA results in a synergistic lowering of total serum cholesterol. Thus, reduction of total serum cholesterol is enhanced with a dual targeting siRNA compared to a single target siRNA.

DEFINITIONS

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A," "T" and "U" each generally stand for a nucleotide that contains guanine, cytosine, adenine, thymidine and uracil as a base, respectively. "T" and "dT" are used interchangeably herein and refer to a deoxyribonucleotide wherein the nucleobase is thymine, e.g., deoxyribothymine. However, it will be understood that the term "ribonucleotide" or "nucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The term "PCSK9" refers to the proprotein convertase subtilisin kexin 9 gene or protein (also known as FH3, HCHOLA3, NARC-1, NARC1). Examples of mRNA sequences to PCSK9 include but are not limited to the following: human: NM_174936, mouse: NM_153565, and rat: NM_199253. Additional examples of PCSK9 mRNA sequences are readily available using, e.g., GenBank.

The term "XBP-1" refers to -Box Protein 1, which is also known as Tax-responsive element-binding protein 5, TREB5, and XBP2. XBP-1 sequence can be found as NCBI GeneID: 7494 and RefSeq ID number: NM_005080 (human) and NM_013842 (mouse). A dsRNA featured in the invention can target a specific XBP-1 isoform, e.g., the spliced form (XBP-1S) or the unspliced form (XBP-1U), or a dsRNA featured in the invention can target both isoforms by binding to a common region of the mRNA transcript.

The term "PCSK5" refers to the Proprotein convertase subtilisin/kexin type 5 gene, mRNA or protein belonging to the subtilisin-like proprotein convertase family.

The term "ApoC3" refers to the Apolipoprotein C-III protein gene, mRNA or protein, and is a very low density lipoprotein (VLDL).

The term "SCAP" refers to the SREBP cleavage-activating protein gene, mRNA or protein. SCAP is a regulatory protein that is required for the proteolytic cleavage of the sterol regulatory element binding protein (SREBP). Example of siRNA targeting SCAP are described in U.S. patent application Ser. No. 11/857,120, filed on Sep. 18, 2007, published as US 20090093426. This application and the siRNA sequences described therein are incorporated by reference for all purposes.

The term "MIG12" is a gene also known as TMSB10 and TB10 refers to the thymosin beta 10 gene. Example of siRNA targeting MIG12 are described International patent application no. PCT/US10/25444, filed on Feb. 25, 2010, published as WO/20XX/XXXXXX. This application and the siRNA sequences described therein are incorporated by reference for all purposes.

As used herein, the term "iRNA" refers to an agent that contains RNA and which mediates the targeted cleavage of an RNA transcript via an RNA-induced silencing complex (RISC) pathway. The term iRNA includes siRNA.

As described in more detail below, the term "siRNA" and "siRNA agent" refers to a dsRNA that mediates the targeted cleavage of an RNA transcript via an RNA-induced silencing complex (RISC) pathway.

A "double-stranded RNA" or "dsRNA," as used herein, refers to an RNA molecule or complex of molecules having a hybridized duplex region that comprises two anti-parallel and substantially complementary nucleic acid strands, which will be referred to as having "sense" and "antisense" orientations with respect to a target RNA.

The term "dual targeting siRNA agent" refers to a composition of two siRNAs, e.g., two dsRNAs. One dsRNA includes an antisense strand with a first region of complementarity to a first target gene, e.g., PCSK9. The second dsRNA include an antisense strand with a second region of complementarity to a second target gene. In some embodiments, the first and second target genes are identical, e.g., both are PCSK9 and each dsRNA targets a different region of PCSK9. In other embodiments, the first and second target genes are different, e.g., the first dsRNA targets PCSK9 and the second dsRNA targets a different gene, e.g., XBP-1.

"Covalent linker" refers to a molecule for covalently joining two molecules, e.g., two dsRNAs. As described in more detail below, the term includes, e.g., a nucleic acid linker, a peptide linker, and the like and includes disulfide linkers.

The term "target gene" refers to a gene of interest, e.g., PCSK9 or a second gene, e.g., XBP-1, targeted by an siRNA of the invention for inhibition of expression.

As described in more detail below, "target sequence" refers to a contiguous portion of the nucleotide sequence of an mRNA molecule formed during the transcription of a target gene, including mRNA that is a product of RNA processing of a primary transcription product. The target portion of the sequence will be at least long enough to serve as a substrate for iRNA-directed cleavage at or near that portion. For example, the target sequence will generally be from 9-36 nucleotides in length, e.g., 15-30 nucleotides in length, including all sub-ranges therebetween.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they may form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but are not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of the target gene (e.g., an mRNA encoding PCSK9 or a second gene, e.g., XBP-1). For example, a polynucleotide is complementary to at least a part of a PCSK9 mRNA if the sequence is substantially complementary to a non-interrupted portion of an mRNA encoding PCSK9.

The skilled artisan will recognize that the term "RNA molecule" or "ribonucleic acid molecule" encompasses not only RNA molecules as expressed or found in nature, but also analogs and derivatives of RNA comprising one or more ribonucleotide/ribonucleoside analogs or derivatives as described herein or as known in the art. Strictly speaking, a "ribonucleoside" includes a nucleoside base and a ribose sugar, and a "ribonucleotide" is a ribonucleoside with one, two or three phosphate moieties. However, the terms "ribonucleoside" and "ribonucleotide" can be considered to be equivalent as used herein. The RNA can be modified in the nucleobase structure or in the ribose-phosphate backbone structure, e.g., as described herein below. However, the molecules comprising ribonucleoside analogs or derivatives must retain the ability to form a duplex. As non-limiting examples, an RNA molecule can also include at least one modified ribonucleoside including but not limited to a 2'-O-methyl modified nucleotide, a nucleoside comprising a 5' phosphorothioate group, a terminal nucleoside linked to a cholesteryl derivative or dodecanoic acid bisdecylamide group, a locked nucleoside, an abasic nucleoside, a 2'-deoxy-2'-fluoro modified nucleoside, a 2'-amino-modified nucleoside, 2'-alkyl-modified nucleoside, morpholino nucleoside, a phosphoramidate or a non-natural base comprising nucleoside, or any combination thereof. Alternatively, an RNA molecule can comprise at least two modified ribonucleosides, at least 3, at least 4, at least 5, at least 6, at least 7, at least 8, at least 9, at least 10, at least 15, at least 20 or more, up to the entire length of the dsRNA molecule. The modifications need not be the same for each of such a plurality of modified ribonucleosides in an RNA molecule. In one embodiment, modified RNAs contemplated for use in methods and compositions described herein are peptide nucleic acids (PNAs) that have the ability to form the required duplex structure and that permit or mediate the specific degradation of a target RNA via a RISC pathway.

In one aspect, a modified ribonucleoside includes a deoxyribonucleoside. In such an instance, an iRNA agent can comprise one or more deoxynucleosides, including, for example, a deoxynucleoside overhang(s), or one or more deoxynucleosides within the double stranded portion of a dsRNA. However, it is self evident that under no circumstances is a double stranded DNA molecule encompassed by the term "iRNA."

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) may be on the sense strand, the antisense strand or any combination thereof. Furthermore, the nucleotide(s) of an overhang can be present on the 5' end, 3' end or both ends of either an antisense or sense strand of a dsRNA. One or more of the nucleotides in the overhang can be replaced with a nucleoside thiophosphate.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

The term "antisense strand" or "guide strand" refers to the strand of an iRNA, e.g., a dsRNA, which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches may be in the internal or terminal regions of the molecule. Generally, the most tolerated mismatches are in the terminal regions, e.g., within 5, 4, 3, or 2 nucleotides of the 5' and/or 3' terminus.

The term "sense strand" or "passenger strand" as used herein, refers to the strand of an iRNA that includes a region that is substantially complementary to a region of the antisense strand as that term is defined herein.

As used herein, the term "SNALP" refers to a stable nucleic acid-lipid particle. A SNALP represents a vesicle of lipids coating a reduced aqueous interior comprising a nucleic acid such as an iRNA or a plasmid from which an iRNA is transcribed. SNALPs are described, e.g., in U.S. Patent Application Publication Nos. 20060240093, 20070135372, and in International Application No. WO 2009082817. These applications are incorporated herein by reference in their entirety.

"Introducing into a cell," when referring to an iRNA, means facilitating or effecting uptake or absorption into the cell, as is understood by those skilled in the art. Absorption or uptake of an iRNA can occur through unaided diffusive or active cellular processes, or by auxiliary agents or devices. The meaning of this term is not limited to cells in vitro; an iRNA may also be "introduced into a cell," wherein the cell is part of a living organism. In such an instance, introduction into the cell will include the delivery to the organism. For example, for in vivo delivery, iRNA can be injected into a tissue site or administered systemically. In vivo delivery can also be by a beta-glucan delivery system, such as those described in U.S. Pat. Nos. 5,032,401 and 5,607,677, and U.S. Publication No. 2005/0281781, which are hereby incorporated by reference in their entirety. In vitro introduction into a cell includes methods known in the art such as electroporation and lipofection. Further approaches are described herein below or known in the art.

As used herein, the term "modulate the expression of," refers to at an least partial "inhibition" or partial "activation" of target gene expression in a cell treated with an iRNA composition as described herein compared to the expression of the target gene in an untreated cell.

The terms "activate," "enhance," "up-regulate the expression of," "increase the expression of," and the like, in so far as they refer to a target gene, herein refer to the at least partial activation of the expression of a target gene, as manifested by an increase in the amount of target mRNA, which may be isolated from or detected in a first cell or group of cells in which a target gene is transcribed and which has or have been treated such that the expression of a target gene is increased, as compared to a second cell or group of cells substantially identical to the first cell or group of cells but which has or have not been so treated (control cells).

In one embodiment, expression of a target gene is activated by at least about 10%, 15%, 20%, 25%, 30%, 35%, 40%, 45%, or 50% by administration of an iRNA as described herein. In some embodiments, a target gene is activated by at least about 60%, 70%, or 80% by administration of an iRNA featured in the invention. In some embodiments, expression of a target gene is activated by at least about 85%, 90%, or 95% or more by administration of an iRNA as described herein. In some embodiments, the target gene expression is increased by at least 1-fold, at least 2-fold, at least 5-fold, at least 10-fold, at least 50-fold, at least 100-fold, at least 500-fold, at least 1000 fold or more in cells treated with an iRNA as described herein compared to the expression in an untreated cell. Activation of expression by small dsRNAs is described, for example, in Li et al., 2006 Proc. Natl. Acad. Sci. U.S.A. 103:17337-42, and in US20070111963 and US2005226848, each of which is incorporated herein by reference.

The terms "silence," "inhibit the expression of," "down-regulate the expression of," "suppress the expression of," and the like, in so far as they refer to a target gene, herein refer to the at least partial suppression of the expression of a target gene, as manifested by a reduction of the amount of target mRNA which may be isolated from or detected in a first cell or group of cells in which a target gene is transcribed and which has or have been treated such that the expression of target gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to target gene expression, e.g., the amount of protein encoded by a target gene, or the number of cells displaying a certain phenotype, e.g., lack of or decreased cytokine production. In principle, target gene silencing may be determined in any cell expressing target, either constitutively or by genomic engineering, and by any appropriate assay. However, when a reference is needed in order to determine whether a given iRNA inhibits the expression of the target gene by a certain degree and therefore is encompassed by the instant invention, the assays provided in the Examples below shall serve as such reference.

For example, in certain instances, expression of a target gene is suppressed by at least about 10%, 15%, 20%, 25%, 30%, 35%, 40%, 45%, 50%, or 55% by administration of an iRNA featured in the invention. In some embodiments, a target gene is suppressed by at least about 60%, 65%, 70%, 75%, or 80% by administration of an iRNA featured in the invention. In some embodiments, a target gene is suppressed by at least about 81%, 82%, 83%, 84%, 85%, 86%, 87%, 88%, 89%, 90%, 91%, 92%, 93%, 94%, 95%, 96%, 97%, 98%, 99%, or more by administration of an iRNA as described herein.

As used herein in the context of target gene expression, the terms "treat," "treatment," and the like, refer to relief from or alleviation of pathological processes mediated by target expression. In the context of the present invention insofar as it relates to any of the other conditions recited herein below (other than pathological processes mediated by target expression), the terms "treat," "treatment," and the like mean to relieve or alleviate at least one symptom associated with such condition, or to slow or reverse the progression or anticipated progression of such condition.

By "lower" in the context of a disease marker or symptom is meant a statistically significant decrease in such level. The decrease can be, for example, at least 10%, at least 15%, at least 20%, at least 25%, at least 30%, at least 35%, at least 40% or more, and is preferably down to a level accepted as within the range of normal for an individual without such disorder.

As used herein, the phrase "therapeutically effective amount" refers to an amount that provides a therapeutic benefit in the treatment or management of pathological processes mediated by target gene expression, e.g., PCSK9 and/or a second gene, e.g., XBP-1, or an overt symptom of pathological processes mediated target gene expression. The phrase "prophylactically effective amount" refer to an amount that provides a therapeutic benefit in the prevention of pathological processes mediated by target gene expression or an overt symptom of pathological processes mediated by target gene expression. The specific amount that is therapeutically effective can be readily determined by an ordinary medical practitioner, and may vary depending on factors known in the art, such as, for example, the type of pathological processes mediated by target gene expression, the patient's history and age, the stage of pathological processes mediated by target gene expression, and the administration of other agents that inhibit pathological processes mediated by target gene expression.

As used herein, a "pharmaceutical composition" comprises a pharmacologically effective amount of an iRNA and a pharmaceutically acceptable carrier. As used herein, "pharmacologically effective amount," "therapeutically effective amount" or simply "effective amount" refers to that amount of an iRNA effective to produce the intended pharmacological or therapeutic result. For example, if a given clinical treatment is considered effective when there is at least a 10% reduction in a measurable parameter associated with a disease or disorder, a therapeutically effective amount of a drug for the treatment of that disease or disorder is the amount necessary to effect at least a 10% reduction in that parameter.

The term "pharmaceutically carrier" refers to a carrier for administration of a therapeutic agent, e.g., a dual targeting siRNA agent. Carriers are described in more detail below, and include lipid formulations, e.g., LNP09 and SNALP formulations.

Double-Stranded Ribonucleic Acid (dsRNA)

Described herein are dual targeting siRNA agents, e.g., siRNAs that inhibit the expression of a PCSK9 gene and a second gene. The dual targeting siRNA agent includes two siRNA covalently linked via, e.g., a disulfide linker. The first siRNA targets a first region of a PCSK9 gene. The second siRNA targets a second gene, e.g., XBP-1, or, e.g., targets a second region of the PCSK9 gene.

The dsRNA can be synthesized by standard methods known in the art as further discussed below, e.g., by use of an automated DNA synthesizer, such as are commercially available from, for example, Applied Biosystems, Inc. Further descriptions of synthesis are found below and in the examples.

Each siRNA is a dsRNA. A dsRNA includes two RNA strands that are sufficiently complementary to hybridize to form a duplex structure under conditions in which the dsRNA will be used. One strand of a dsRNA (the antisense strand) includes a region of complementarity that is substantially complementary, and generally fully complementary, to a target sequence, derived from the sequence of an mRNA formed during the expression of a target gene. The other strand (the sense strand) includes a region that is complementary to the antisense strand, such that the two strands hybridize and form a duplex structure when combined under suitable conditions.

Where the duplex region is formed from two strands of a single molecule, the molecule can have a duplex region separated by a single stranded chain of nucleotides (herein referred to as a "hairpin loop") between the 3'-end of one strand and the 5'-end of the respective other strand forming the duplex structure. The hairpin loop can comprise at least one unpaired nucleotide; in some embodiments the hairpin loop can comprise at least 3, at least 4, at least 5, at least 6, at least 7, at least 8, at least 9, at least 10, at least 20, at least 23 or more unpaired nucleotides.

Where the two substantially complementary strands of a dsRNA are comprised by separate RNA molecules, those molecules need not, but can be covalently connected. Where the two strands are connected covalently by means other than a hairpin loop, the connecting structure is referred to as a "linker."

Generally, the duplex structure of the siRNA, e.g., dsRNA, is between 15 and 30 inclusive, more generally between 18 and 25 inclusive, yet more generally between 19 and 24 inclusive, and most generally between 19 and 21 base pairs in length, inclusive. Considering a duplex between 9 and 36 base pairs, the duplex can be any length in this range, for example, 9, 10, 11, 12, 13, 14, 15, 16, 17, 18, 19, 20, 21, 22, 23, 24, 25, 26, 27, 28, 29, 30, 31, 32, 33, 34, 35, or 36 and any sub-range therein between, including, but not limited to 15-base pairs, 15-26 base pairs, 15-23 base pairs, 15-22 base pairs, 15-21 base pairs, 15-20 base pairs, 15-19 base pairs, 15-18 base pairs, 15-17 base pairs, 18-30 base pairs, 18-26 base pairs, 18-23 base pairs, 18-22 base pairs, 18-21 base pairs, 18-20 base pairs, 19-30 base pairs, 19-26 base pairs, 19-23 base pairs, 19-22 base pairs, 19-21 base pairs, 19-20 base pairs, 20-30 base pairs, 20-26 base pairs, 20-25 base pairs, 20-24 base pairs, 20-23 base pairs, 20-22 base pairs, 20-21 base pairs, 21-30 base pairs, 21-26 base pairs, 21-25 base pairs, 21-24 base pairs, 21-23 base pairs, or 21-22 base pairs.

The two siRNAs in the dual targeting siRNA agent can have duplex lengths that are identical or that differ.

The region of complementarity to the target sequence in an siRNA is between 15 and inclusive, more generally between 18 and 25 inclusive, yet more generally between 19 and 24 inclusive, and most generally between 19 and 21 nucleotides in length, inclusive. In some embodiments, the dsRNA is between 15 and 20 nucleotides in length, inclusive, and in other embodiments, the dsRNA is between 25 and 30 nucleotides in length, inclusive. The region of complementarity can be 15, 16, 17, 18, 19, 20, 21, 22, 23, 24, 25, 26, 27, 28, 29, or 30 nucleotides in length. As non-limiting examples, the target sequence can be from 15-30 nucleotides, 15-26 nucleotides, 15-23 nucleotides, 15-22 nucleotides, 15-21 nucleotides, 15-nucleotides, 15-19 nucleotides, 15-18 nucleotides, 15-17 nucleotides, 18-30 nucleotides, 18-26 nucleotides, 18-23 nucleotides, 18-22 nucleotides, 18-21 nucleotides, 18-20 nucleotides, 19-30 nucleotides, 19-26 nucleotides, 19-23 nucleotides, 19-22 nucleotides, 19-21 nucleotides, 19-20 nucleotides, 20-30 nucleotides, 20-26 nucleotides, 20-25 nucleotides, 20-24 nucleotides, 20-23 nucleotides, 20-22 nucleotides, 20-21 nucleotides, 21-30 nucleotides, 21-26 nucleotides, 21-25 nucleotides, 21-24 nucleotides, 21-23 nucleotides, or 21-22 nucleotides. In some embodiments the target sequence is 15, 16, 17, 18, 19, 20, 21, 22, 23, 24, or 25 nucleotides.

The two siRNAs in the dual targeting siRNA agent can have regions of complementarity that are identical in length or that differ in length.

Any of the dsRNA, e.g., siRNA as described herein may include one or more single-stranded nucleotide overhangs. In one embodiment, at least one end of a dsRNA has a single-stranded nucleotide overhang of 1 to 4, or 1 or 2 or 3 or 4 nucleotides. dsRNAs having at least one nucleotide overhang have unexpectedly superior inhibitory properties relative to their blunt-ended counterparts. Generally, the single-stranded overhang is located at the 3'-terminal end of the antisense strand or, alternatively, at the 3'-terminal end of the sense strand. The dsRNA can also have a blunt end, generally located at the 5'-end of the antisense strand. In another embodiment, one or more of the nucleotides in the overhang is replaced with a nucleoside thiophosphate. The two siRNAs in the dual targeting siRNA agent can have different or identical overhangs as described by location, length, and nucleotide.

The dual targeting siRNA agent includes at least a first siRNA targeting a first region of a PCSK9 gene. In one embodiment, a PCSK9 gene is a human PCSK9 gene. In another embodiment the PCSK9 gene is a mouse or a rat PCSK9 gene. Exemplary siRNA targeting PCSK9 are described in U.S. patent application Ser. No. 11/746,864 filed on May 10, 2007 (now U.S. Pat. No. 7,605,251) and International Patent Application No. PCT/US2007/068655 filed May 10, 2007 (published as WO 2007/134161). Additional disclosure can be found in U.S. patent application Ser. No. 12/478,452 filed Jun. 4, 2009 (published as US 2010/0010066) and International Patent Application No. PCT/US2009/032743 filed Jan. 30, 2009 (published as WO 2009/134487). The sequences of the target, sense, and antisense strands are incorporated by reference for all purposes.

Tables 1, 2, and 4-8 disclose sequences of the target, sense strands, and antisense strands of PCSK9 targeting siRNA.

In one embodiment the first siRNA is AD-9680. The dsRNA AD-9680 targets the human PCSK 9 gene at nucleotides 3530-3548 of a human PCSK9 gene (accession number NM_174936).

TABLE 1

AID-9680 siRNA sequences

| Table 1: AD-9680 | Sequence 5' to 3' | SEQ ID NO: |
|---|---|---|
| Target sequence | UUCUAGACCUGUUUUGCUU | 4142 |
| Sense strand | UUCUAGACCUGUUUUGCUU | 4143 |
| Sense strand, modified | uucuAGAccuGuuuuGcuuTsT | 4144 |
| Antisense strand | AAGCAAAACAGGUCUAGAA | 4145 |
| Antisense strand, modified | AAGcAAAAcAGGUCuAGAATsT | 4146 |

In another embodiment, the first siRNA is AD-10792. The dsRNA AD-10792 targets the PCSK9 gene at nucleotides 1091-1109 of a human PCSK9 gene (accession number NM_174936). AD-10792 is also complementary to rodent PCSK9.

TABLE 2

AD-10792 siRNA sequences

| Table 2: AD-10792 | Sequence 5' to 3' | SEQ ID NO: |
|---|---|---|
| Target sequence | GCCUGGAGUUUAUUCGGAA | 4147 |
| Sense strand | GCCUGGAGUUUAUUCGGAA | 4148 |
| Sense strand, modified | GccuGGAGuuuAuucGGAATsT | 4149 |
| Antisense strand | UUCCGAAUAAACUCCAGGC | 4150 |
| Antisense strand, modified | UUCCGAAuAAACUCcAGGCTsT | 4151 |

The second siRNA of the dual targeting siRNA agent targets a second gene. In one embodiment, the second gene is PCSK9, and the second siRNA target a region of PCSK9 that is different from the region targeted by the first siRNA.

Alternatively, the second siRNA targets a different second gene. Examples include genes that interact with PCSK9 and/or are involved with lipid metabolism or cholesterol metabolism. For example, the second target gene can be XBP-1, PCSK5, ApoC3, SCAP, MIG12, HMG CoA Reductase, or IDOL (Inducible Degrader of the LDLR) and the like. In one embodiment, the second gene is a human gene. In another embodiment the second gene is a mouse or a rat gene.

In one embodiment, the second siRNA targets the XBP-1 gene. Exemplary siRNA targeting XBP-1 can be found in U.S. patent application Ser. No. 12/425,811 filed Apr. 17, 2009 (published as US 2009-0275638). The sequences of the target, sense, and antisense strands are incorporated by reference for all purposes.

Tables 3 and 9-13 disclose sequences of the target, sense strands, and antisense strands of XBP-1 targeting siRNA.

In one embodiment the first siRNA is AD-18038. The dsRNA AD-18038 targets the human XBP-1 gene at nucleotides 896-914 of a human XBP-1 gene (accession number NM_001004210).

TABLE 3

AD-18038 siRNA sequences

| Table 3: AD-18038 | Sequence 5' to 3' | SEQ ID NO: |
|---|---|---|
| Target sequence | CACCCUGAAUUCAUUGUCU | 4153 |
| Sense strand | CACCCUGAAUUCAUUGUCU | 4154 |
| Sense strand, modified | cAcccuGAAuucAuuGucudTsdT | 4155 |
| Antisense strand | AGACAAUGAAUUCAGGGUG | 4156 |
| Antisense strand, modified | AGAcAAUGAAUUcAGGGUGdTsdT | 4157 |

Additional dsRNA

A dsRNAs having a partial sequence of at least 15, 16, 17, 18, 19, 20, or more contiguous nucleotides from one of the sequences in Tables 1-13, and differing in their ability to inhibit the expression of a target gene by not more than 5, 10, 15, 20, 25, or 30% inhibition from a dsRNA comprising the full sequence, are contemplated according to the invention.

In addition, the RNAs provided in Tables 1-13 identify a site in the target gene transcript that is susceptible to RISC-mediated cleavage. As such, the present invention further features iRNAs that target within one of such sequences. As used herein, an iRNA is said to target within a particular site of an RNA transcript if the iRNA promotes cleavage of the transcript anywhere within that particular site. Such an iRNA will generally include at least 15 contiguous nucleotides from one of the sequences provided herein coupled to additional nucleotide sequences taken from the region contiguous to the selected sequence in a target gene.

While a target sequence is generally 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that may serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified, for example, above represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in Tables 1-13, further optimization could be achieved by systematically either adding or removing nucleotides to generate longer or shorter sequences and testing those and sequences generated by walking a window of the longer or shorter size up or down the target RNA from that point. Again, coupling this approach to generating new candidate targets with testing for effectiveness of iRNAs based on those target sequences in an inhibition assay as known in the art or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes, etc.) as an expression inhibitor.

An iRNA as described in Tables 1-13 can contain one or more mismatches to the target sequence. In one embodiment, an iRNA as described in Tables 1-13 contains no more than 3 mismatches. If the antisense strand of the iRNA contains mismatches to a target sequence, it is preferable that the area of mismatch not be located in the center of the region of complementarity. If the antisense strand of the iRNA contains mismatches to the target sequence, it is preferable that the mismatch be restricted to be within the last 5 nucleotides from either the 5' or 3' end of the region of complementarity. For example, for a 23 nucleotide iRNA agent RNA strand which is complementary to a region of a PCSK9 gene, the RNA strand generally does not contain any mismatch within the central 13 nucleotides. The methods described herein or methods known in the art can be used to determine whether an iRNA containing a mismatch to a target sequence is effective in inhibiting the expression of a PCSK9 gene. Consideration of the efficacy of iRNAs with mismatches in inhibiting expression of a PCSK9 gene is important, especially if the particular region of complementarity in a PCSK9 gene is known to have polymorphic sequence variation within the population.

Covalent Linkage

The dual targeting siRNA agents of the invention include two siRNAs joined via a covalent linker. Covalent linkers are well-known to one of skill in the art and include, e.g., a nucleic acid linker, a peptide linker, and the like.

The covalent linker joins the two siRNAs. The covalent linker can join two sense strands, two antisense strands, one sense and one antisense strand, two sense strands and one antisense strand, two antisense strands and one sense strand, or two sense and two antisense strands.

The covalent linker can include RNA and/or DNA and/or a peptide. The linker can be single stranded, double stranded, partially single strands, or partially double stranded. In some embodiments the linker includes a disulfide bond. The linker can be cleavable or non-cleavable.

The covalent linker can be, e.g., dTsdTuu=(5'-2'deoxythymidyl-3'-thiophosphate-5'-2'deoxythymidyl-3'-phosphate-5'-uridyl-3'-phosphate-5'-uridyl-3'-phosphate); rUsrU (a thiophosphate linker: 5'-uridyl-3'-thiophosphate-5'-uridyl-3'-phosphate); an rUrU linker; dTsdTaa (aadTsdT, 5'-2'deoxythymidyl-3'-thiophosphate-5'-2'deoxythymidyl-3'-phosphate-5'-adenyl-3'-phosphate-5'-adenyl-3'-phosphate); dTsdT (5'-2'deoxythymidyl-3'-thiophosphate-5'-2' deoxythymidyl-3'-phosphate); dTsdTuu=uudTsdT=5'-2'deoxythymidyl-3'-thiophosphate-5'-2'deoxythymidyl-3'-phosphate-5'-uridyl-3'-phosphate-5'-uridyl-3'-phosphate.

The covalent linker can be a polyRNA, such as poly(5'-adenyl-3'-phosphate-AAAAAAAA) or poly(5'-cytidyl-3'-phosphate-5'-uridyl-3'-phosphate—CUCUCUCU)), e.g., $X_n$ single stranded poly RNA linker wherein n is an integer from 2-50 inclusive, preferable 4-15 inclusive, most preferably 7-8 inclusive. Modified nucleotides or a mixture of nucleotides can also be present in said polyRNA linker. The covalent linker can be a polyDNA, such as poly(5'-2'deoxythymidyl-3'-phosphate-TTTTTTTT), e.g., wherein n is an integer from 2-50 inclusive, preferable 4-15 inclusive, most preferably 7-8 inclusive. Modified nucleotides or a mixture of nucleotides can also be present in said polyDNA linker. a single stranded polyDNA linker wherein n is an integer from 2-50 inclusive, preferable 4-inclusive, most preferably 7-8 inclusive. Modified nucleotides or a mixture of nucleotides can also be present in said polyDNA linker.

The covalent linker can include a disulfide bond, optionally a bis-hexyl-disulfide linker. In one embodiment, the disulfide linker is

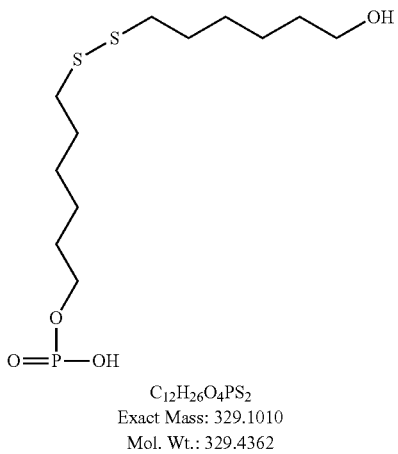

$C_{12}H_{26}O_4PS_2$
Exact Mass: 329.1010
Mol. Wt.: 329.4362

The covalent linker can include a peptide bond, e.g., include amino acids. In one embodiment, the covalent linker is a 1-10 amino acid long linker, preferably comprising 4-5 amino acids, optionally X-Gly-Phe-Gly-Y wherein X and Y represent any amino acid.

The covalent linker can include HEG, a hexaethylenglycol linker.

Modifications

In yet another embodiment, at least one of the siRNA of the dual targeting siRNA agent is chemically modified to enhance stability or other beneficial characteristics. The nucleic acids featured in the invention may be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, (a) end modifications, e.g., 5' end modifications (phosphorylation, conjugation, inverted linkages, etc.) 3' end modifications (conjugation, DNA nucleotides, inverted linkages, etc.), (b) base modifications, e.g., replacement with stabilizing bases, destabilizing bases, or bases that base pair with an expanded repertoire of partners, removal of bases (abasic nucleotides), or conjugated bases, (c) sugar modifications (e.g., at the 2' position or 4' position) or replacement of the sugar, as well as (d) backbone modifications, including modification or replacement of the phosphodiester linkages. Specific examples of RNA compounds useful in this invention include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In particular embodiments, the modified RNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, each of which is herein incorporated by reference Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones: sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other RNA mimetics suitable or contemplated for use in iRNAs, both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone.

Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$—[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs may also contain one or more substituted sugar moieties. The iRNAs, e.g., dsRNAs, featured herein can include one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$).$_n$O$CH_3$, O($CH_2$)$_n$$NH_2$, O($CH_2$)$_n$$CH_3$, O($CH_2$)$_n$$ONH_2$, and O($CH_2$)$_n$ON[($CH_2$)$_n$$CH_3$)]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a O($CH_2$)$_2$ON($CH_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$, also described in examples herein below.

Other modifications include 2'-methoxy (2'-$OCH_3$), 2'-aminopropoxy (2'-$OCH_2CH_2CH_2NH_2$) and 2'-fluoro (2'-F). Similar modifications may also be made at other positions on the RNA of an iRNA, particularly the 3' position of the sugar on the 3' terminal nucleotide or in 2'-5' linked dsRNAs and the 5' position of 5' terminal nucleotide. iRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference.

An iRNA may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference, and U.S. Pat. No. 5,750,692, also herein incorporated by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

Representative U.S. patents that teach the preparation of locked nucleic acid nucleotides include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine(ether), N-(aminocaproyl)-4-hydroxyprolinol (Hyp-C6-amino), 2'-docosanoyl-uridine-3'-phosphate, inverted base dT(idT) and others. Disclosure of this modification can be found in U.S. Provisional Patent Application No. 61/223,665 ("the '665 application"), filed Jul. 7, 2009, entitled "Oligonucleotide End Caps" and International patent application no. PCT/US10/41214, filed Jul. 7, 2010.

Ligands

Another modification of the RNA of an iRNA featured in the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., Proc. Natl. Acad. Sci. USA, 1989, 86: 6553-6556), cholic acid (Manoharan et al., Biorg. Med. Chem. Let., 1994, 4:1053-1060), a thioether, e.g., beryl-5-tritylthiol (Manoharan et al., Ann. N.Y. Acad. Sci., 1992, 660:306-309; Manoharan et al., Biorg. Med. Chem. Let., 1993, 3:2765-2770), a thiocholesterol (Oberhauser et al., Nucl. Acids Res., 1992, 20:533-538), an aliphatic chain. e.g., dodecandiol or undecyl residues (Saison-Behmoaras et al., EMBO J, 1991, 10:1111-1118; Kabanov et al., FEBS Lett., 1990, 259:327-330; Svinarchuk et al., Biochimie, 1993, 75:49-54), a phospholipid, e.g., di-hexadecyl-rac-glycerol or triethyl-ammonium 1,2-di-O-hexadecyl-rac-glycero-3-phosphonate (Manoharan et al., Tetrahedron Lett., 1995, 36:3651-3654; Shea et al., Nucl. Acids Res., 1990, 18:3777-3783), a polyamine or a polyethylene glycol chain (Manoharan et al., Nucleosides & Nucleotides, 1995, 14:969-973), or adamantane acetic acid (Manoharan et al., Tetrahedron Lett., 1995, 36:3651-3654), a palmityl moiety (Mishra et al., Biochim. Biophys. Acta, 1995, 1264:229-237), or an octadecylamine or hexylamino-carbonyloxycholesterol moiety (Crooke et al., J. Pharmacol. Exp. Ther., 1996, 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In one ligand, the ligand is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to modulate, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low density lipoprotein (LDL).

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO:1). An RFGF analogue (e.g., amino acid sequence AALLPVLLAAP (SEQ ID NO:2)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:3)) and the *Drosophila* Antennapedia protein (RQIKIWFQNRRMKWKK (SEQ ID NO: 4)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Preferably the peptide or peptidomimetic tethered to a dsRNA agent via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide moiety can be used to target a tumor cell, such as an endothelial tumor cell or a breast cancer tumor cell (Zitzmann et al., Cancer Res., 62:5139-43, 2002). An RGD peptide can facilitate targeting of an dsRNA agent to tumors of a variety of other tissues, including the lung, kidney, spleen, or liver (Aoki et al., Cancer Gene Therapy 8:783-787, 2001). Preferably, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver a iRNA agent to a tumor cell expressing $\alpha_v\beta_3$ (Haubner et al., Jour. Nucl. Med., 42:326-336, 2001).

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; each of which is herein incorporated by reference.

Chimeras

It is not necessary for all positions in a given compound to be uniformly modified, and in fact more than one of the aforementioned modifications may be incorporated in a single compound or even at a single nucleoside within an iRNA. The present invention also includes iRNA compounds that are chimeric compounds. "Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

Non-Ligand Groups

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction may be performed either with the RNA still bound to the solid support or following cleavage of the RNA, in solution phase. Purification of the RNA conjugate by HPLC typically affords the pure conjugate.

Delivery of iRNA

The delivery of an iRNA to a subject in need thereof can be achieved in a number of different ways. In vivo delivery can be performed directly by administering a composition comprising an iRNA, e.g. a dsRNA, to a subject. Alternatively, delivery can be performed indirectly by administering one or more vectors that encode and direct the expression of the iRNA. These alternatives are discussed further below.

Direct Delivery

In general, any method of delivering a nucleic acid molecule can be adapted for use with an iRNA (see e.g., Akhtar S. and Julian R L. (1992) Trends Cell. Biol. 2(5):139-144 and WO94/02595, which are incorporated herein by reference in their entireties). However, there are three factors that are important to consider in order to successfully deliver an iRNA molecule in vivo: (a) biological stability of the delivered molecule, (2) preventing non-specific effects, and (3) accumulation of the delivered molecule in the target tissue. The non-specific effects of an iRNA can be minimized by local administration, for example by direct injection or implantation into a tissue (as a non-limiting example, a tumor) or topically administering the preparation. Local administration to a treatment site maximizes local concentration of the agent, limits the exposure of the agent to systemic tissues that may otherwise be harmed by the agent or that may degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) Retina 24:132-138) and subretinal injections in mice (Reich, S J., et al (2003) Mol. Vis. 9:210-216) were both shown to prevent neovascularization in an experimental model of age-related macular degeneration. In addition, direct intratumoral injection of a dsRNA in mice reduces tumor volume (Pille, J., et al (2005) Mol. Ther. 11:267-274) and can prolong survival of tumor-bearing mice (Kim, W J., et al (2006) Mol. Ther. 14:343-350; Li, S., et al (2007) Mol. Ther. 15:515-523). RNA interference has also shown success with local delivery to the CNS by direct injection (Dorn, G., et al. (2004) Nucleic Acids 32:e49; Tan, P H., et al (2005) Gene Ther. 12:59-66; Makimura, H., et al (2002) BMC Neurosci. 3:18; Shishkina, G T., et al (2004) Neuroscience 129: 521-528; Thakker, E R., et al (2004) Proc. Natl. Acad. Sci. U.S.A. 101:17270-17275; Akaneya, Y., et al (2005) J. Neurophysiol. 93:594-602) and to the lungs by intranasal administration (Howard, K A., et al (2006) Mol. Ther. 14:476-484; Zhang, X., et al (2004) J. Biol. Chem. 279:10677-10684; Bitko, V., et al (2005) Nat. Med. 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) Nature 432:173-178). Conjugation of an iRNA to an aptamer has been shown to inhibit tumor growth and mediate tumor regression in a mouse model of prostate cancer (McNamara, JO., et al (2006) Nat. Biotechnol. 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) Journal of Controlled Release 129(2): 107-116) that encases an iRNA. The formation of vesicles or micelles further prevents degradation of the iRNA when administered systemically. Methods for making and administering cationic-iRNA complexes are well within the abilities of one skilled in the art (see e.g., Sørensen, DR., et al (2003) J. Mol. Biol 327:761-766; Verma, U N., et al (2003) Clin. Cancer Res. 9:1291-1300; Arnold, A S et al (2007) J. Hypertens. 25:197-205, which are incorporated herein by reference in their entirety). Some non-limiting examples of drug delivery systems useful for systemic delivery of iRNAs include DOTAP (Sørensen, DR., et al (2003), supra; Verma, U N., et al (2003), supra), Oligofectamine, "solid nucleic acid lipid particles" (Zimmermann, T S., et al (2006) Nature 441:111-114), cardiolipin (Chien. PY., et al (2005) Cancer Gene Ther. 12:321-328; Pal, A., et al (2005) Int J. Oncol. 26:1087-1091), polyethyleneimine (Bonnet M E., et al (2008) Pharm. Res. August 16 Epub ahead of print; Aigner, A. (2006) J. Biomed. Biotechnol. 71659), Arg-Gly-Asp (RGD) peptides (Liu, S. (2006) Mol. Pharm. 3:472-487), and polyamidoamines (Tomalia, D A., et al (2007) Biochem. Soc. Trans. 35:61-67; Yoo, H., et al (1999) Pharm. Res. 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

Vector Encoded dsRNAs

In another aspect, the dsRNAs of the invention can be expressed from transcription units inserted into DNA or RNA vectors (see, e.g., Couture, A, et al., *TIG*. (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as an inverted repeat joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

iRNA expression plasmids can be transfected into target cells as a complex with cationic lipid carriers (e.g., Oligofectamine) or non-cationic lipid-based carriers (e.g. Transit-TKO™). Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (1) polyoma virus vectors; (g) papilloma virus vectors; (h) picornavirus vectors; (i) pox virus vectors such as an *orthopox*, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct may be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, FASEB J. 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the iRNA transgene.

In a specific embodiment, viral vectors that contain nucleic acid sequences encoding an iRNA can be used. For example, a retroviral vector can be used (see Miller et al., Meth. Enzymol. 217:581-599 (1993)). These retroviral vectors contain the components necessary for the correct packaging of the viral genome and integration into the host cell DNA. The nucleic acid sequences encoding an iRNA are cloned into one or more vectors, which facilitates delivery of the nucleic acid into a patient. More detail about retroviral vectors can be found, for example, in Boesen et al., Biotherapy 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., J. Clin. Invest. 93:644-651 (1994); Kiem et al., Blood 83:1467-1473 (1994); Salmons and Gunzberg, Human Gene Therapy 4:129-141 (1993); and Grossman and Wilson, Curr. Opin. in Genetics and Devel. 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, Current Opinion in Genetics and Development 3:499-503 (1993) present a review of adenovirus-based gene therapy. Bout et al., Human Gene Therapy 5:3-10 (1994) demonstrated the use of adenovirus vectors to transfer genes to the respiratory epithelia of rhesus monkeys. Other instances of the use of adenoviruses in gene therapy can be found in Rosenfeld et al., Science 252:431-434 (1991): Rosenfeld et al., Cell 68:143-155 (1992); Mastrangeli et al., J. Clin. Invest. 91:225-234 (1993); PCT Publication WO94/12649; and Wang, et al., Gene Therapy 2:775-783 (1995). A suitable AV vector for expressing an iRNA featured in the invention, a method for constructing the recombinant AV vector, and a method for delivering the vector into target cells, are described in Xia H et al. (2002), Nat. Biotech. 20: 1006-1010.

Use of Adeno-associated virus (AAV) vectors is also contemplated (Walsh et al., Proc. Soc. Exp. Biol. Med. 204:289-300 (1993); U.S. Pat. No. 5,436,146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. No. 5,252,479; U.S. Pat. No. 5,139,941; International Patent Application No. WO 94/13788: and International Patent Application No. WO 93/24641, the entire disclosures of which are herein incorporated by reference.

Another preferred viral vector is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), J Virol 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

Pharmaceutical Compositions Containing iRNA

In one embodiment, the invention provides pharmaceutical compositions containing a dual targeting siRNA agent, as described herein, and a pharmaceutically acceptable carrier. The pharmaceutical composition containing the siRNA is useful for treating a disease or disorder associated with the expression or activity of a target gene, such as pathological processes mediated by PCSK9 expression. Such pharmaceutical compositions are formulated based on the mode of delivery. One example is compositions that are formulated for systemic administration via parenteral delivery, e.g., by intravenous (IV) delivery. Another example is compositions that are formulated for direct delivery into the brain parenchyma, e.g., by infusion into the brain, such as by continuous pump infusion.

The pharmaceutical compositions featured herein are administered in dosages sufficient to inhibit expression of the target genes. In general, a suitable dose of siRNA will be in the range of 0.01 to 200.0 milligrams per kilogram body weight of the recipient per day, generally in the range of 1 to 50 mg per kilogram body weight per day. For example, the dsRNA can be administered at 0.01 mg/kg, 0.02 mg/kg, 0.03 mg/kg, 0.04 mg/kg, 0.05 mg/kg, 0.06 mg/kg, 0.07 mg/kg, 0.08 mg/kg, 0.09 mg/kg, 0.1 mg/kg, 0.2 mg/kg, 0.3 mg/kg, 0.4 mg/kg, 0.5 mg/kg, 0.6 mg/kg, 0.7 mg/kg, 0.8 mg/kg, 0.9 mg/kg, 1 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2 mg/kg, 3 mg/kg, 4 mg/kg, 5 mg/kg, 6 mg/kg, 7 mg/kg, 8 mg/kg, 9 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, 20 mg/kg, 21 mg/kg, 22 mg/kg, 23 mg/kg, 24 mg/kg, 25 mg/kg, 26 mg/kg, 27 mg/kg, 28 mg/kg, 29 mg/kg, 30 mg/kg, 31 mg/kg, 32 mg/kg, 33 mg/kg, 34 mg/kg, 35 mg/kg, 36 mg/kg, 37 mg/kg, 38 mg/kg, 39 mg/kg, 40 mg/kg, 41 mg/kg, 42 mg/kg, 43 mg/kg, 44 mg/kg, 45 mg/kg, 46 mg/kg, 47 mg/kg, 48 mg/kg, 49 mg/kg, or 50 mg/kg per single dose.

The pharmaceutical composition may be administered once daily, or the iRNA may be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as could be used with the agents of the present invention. In this embodiment, the dosage unit contains a corresponding multiple of the daily dose.

The effect of a single dose of siRNA on PCSK9 levels can be long lasting, such that subsequent doses are administered at not more than 3, 4, or 5 day intervals, or at not more than 1, 2, 3, or 4 week intervals.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes mediated by PCSK9 expression. Such models can be used for in vivo testing of iRNA, as well as for determining a therapeutically effective dose. A suitable mouse model is, for example, a mouse containing a transgene expressing human PCSK9.

The present invention also includes pharmaceutical compositions and formulations that include the iRNA compounds featured in the invention. The pharmaceutical compositions of the present invention may be administered in a number of ways depending upon whether local or systemic treatment is desired and upon the area to be treated. Administration may be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdemial, e.g., via an implanted device; or intracranial, e.g., by intraparenchymal, intrathecal or intraventricular, administration.

The iRNA can be delivered in a manner to target a particular tissue, such as the liver (e.g., the hepatocytes of the liver).

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention may be encapsulated within liposomes or may form complexes thereto, in particular to cationic liposomes. Alternatively, iRNAs may be complexed to lipids, in particular to cationic lipids. Suitable fatty acids and esters include but are not limited to arachidonic acid, oleic acid, cicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to traverse intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S. T. P. Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Nucleic Acid Lipid Particles

In one embodiment, a dual targeting siRNA agent featured in the invention is fully encapsulated in the lipid formulation, e.g., to form a nucleic acid-lipid particle, e.g., a SPLP, pSPLP, or SNALP. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. Nucleic acid-lipid particles, e.g., SNALPs, typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP", which include an encapsulated condensing agent-nucleic acid complex as set forth in PCT Publication No. WO 00/03683.

The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. For example, the mean diameter of the particles can be about 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 140 nm, 145 nm, or 150 nm.

In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. The lipid to dsRNA ratio can be about 5:1, 6:1, 7:1, 8:1, 9:1, 10:1, 11:1, 12:1, 113:1, 14:1, 15:1, 16:1, 17:1, 18:1, 19:1, 20:1, 21:1, 22:1, 23:1, 24:1, 25:1, 26:1, 27:1, 28:1, 29:1, 30:1, 31:1, 32:1, 33:1, 34:1, 35:1, 36:1, 37:1, 38:1, 39:1, 40:1, 41:1, 42:1, 43:1, 44:1, 45:1, 46:1, 47:1, 48:1, 49:1, or 50:1.

The nucleic acid lipid particles include a cationic lipid. The cationic lipid may be, for example, N,N-dioleyl-N,N-dimethylammonium chloride (DODAC), N,N-distearyl-N,N-dimethylammonium bromide (DDAB), N-(1-(2,3-dioleoyloxy)propyl)-N,N,N-trimethylammonium chloride (DOTAP), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, 2,2-Dilinoleyl-4-dimethylaminoethyl-[1,3]-dioxolane (XTC), (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis (2-hydroxydodecyl)amino)ethyl)(2-hydroxydodecyl)amino) ethyl)piperazin-1-yl)ethylazanediyl)didodecan-2-ol (Tech G1, e.g., C12-200), or a mixture thereof.

The cationic lipid may comprise from about 10 mol % to about 70 mol % or about 40 mol % of the total lipid present in the particle. The cationic lipid may comprise 10 mol %, 15 mol %, 20 mol %, 25 mol %, 30 mol %, 35 mol %, 40 mol %, 45 mol %, 50 mol %, 55 mol %, 60 mol %, 65 mol %, 70 mol %, 75 mol %, 80 mol %, 85 mol %, 90 mol %, or 95 mol % of the total lipid present in the particle. The cationic lipid may comprise 57.1 mol % or 57.5 mol % of the total lipid present in the particle.

In one embodiment, the compound 2,2-Dilinoleyl-4-dimethylaminoethyl-[1,3]-dioxolane (XTC) can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2,2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The nucleic acid lipid particle generally includes a non-cationic lipid. The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof.

The non-cationic lipid may be from about 5 mol % to about 90 mol %, about 10 mol %, or about 58 mol % if cholesterol is included, of the total lipid present in the particle. The non-cationic lipid may be about 5 mol %, 6 mol %, 7 mol %, 7.5 mol %, 7.7 mol %, 8 mol %, 9 mol %, 10 mol %, 11 mol %, 12 mol %, 13 mol %, 14 mol %, 15 mol %, 16 mol %, 17 mol %, 18 mol %, 19 mol %, 20 mol %, 25 mol %, 30 mol %, 35 mol %, 40 mol %, 45 mol %, 50 mol %, 55 mol %, 60 mol %, 65 mol %, 70 mol %, 75 mol %, 80 mol %, 85 mol %, 90 mol %, or 95 mol %.

The nucleic acid lipid particle generally includes a conjugated lipid. The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-

LNP01

In one embodiment, the lipidoid ND98.4HCl (MW 1487) (see U.S. patent application Ser. No. 12/056,230, filed Mar. 26, 2008, which is herein incorporated by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7. e.g., about pH 6.9, about pH 7.0, about pH 7.1, about pH 7.2, about pH 7.3, or about pH 7.4.

Formula 1

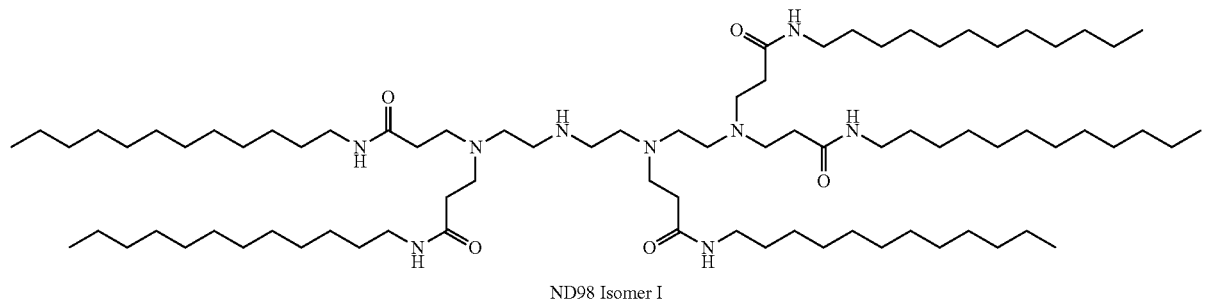

ND98 Isomer I

DAA conjugate may be, for example, a PEG-dilauryloxypropyl ($C_{i2}$), a PEG-dimyristyloxypropyl ($C_{i4}$), a PEG-dipalmityloxypropyl ($C_{i6}$), or a PEG-distearyloxypropyl ($C_{l8}$). The conjugated lipid can be PEG-DMG (PEG-didimyristoyl glycerol (C14-PEG, or PEG-C14) (PEG with avg mol wt of 2000); PEG-DSG (PEG-distyryl glycerol (C18-PEG, or PEG-C18) (PEG with avg mol wt of 2000); or PEG-cDMA: PEG-carbamoyl-1,2-dimyristyloxypropylamine (PEG with avg mol wt of 2000).

The conjugated lipid that prevents aggregation of particles may be from 0 mol % to about 20 mol % or about 1.0, 2.0, 3.0, 4.0, 5.0, 6.0, 7.0, 8.0, 9.0, 10.0, 11.0, 12.0, 13.0, 14.0, 15.0, 16.0 17.0, 18, 19.0 or 20.0 mol % of the total lipid present in the particle.

In some embodiments, the nucleic acid-lipid particle further includes cholesterol at, e.g., about 10 mol % to about 60 mol % or about 48 mol % of the total lipid present in the particle. For example, the nucleic acid-lipid particle further includes cholesterol at about 5 mol %, 10 mol %, 15 mol %, 20 mol %, 25 mol %, 30 mol %, 35 mol %, 40 mol %, 45 mol %, 50 mol %, 55 mol %, or 60 mol %. The nucleic acid-lipid particle can include cholesterol at about 31.5 mol %, 34.4 mol %, 35 mol %, 38.5 mol %, or 40 mol % of the total lipid present in the particle.

LNP01 formulations are described, e.g., in International Application Publication No. WO 2008/042973, which is hereby incorporated by reference.

Exemplary Nucleic Acid Lipid Particles

Additional exemplary lipid-dsRNA formulations are as follows:

TABLE A

| Cationic Lipid | | cationic lipid/non-cationic lipid/cholesterol/PEG-lipid conjugate Mol % ratios Lipid:siRNA ratio |
|---|---|---|
| SNALP | DLinDMA | DLinDMA/DPPC/Cholesterol/PEG-cDMA (57.1/7.1/34.4/1.4) lipid:siRNA ~7:1 |
| S-XTC | XTC | XTC/DPPC/Cholesterol/PEG-cDMA 57.1/7.1/34.4/1.4 lipid:siRNA ~7:1 |
| LNP05 | XTC | XTC/DSPC/Cholesterol/PEG-DMG 57.5/7.5/31.5/3.5 lipid:siRNA ~6:1 |
| LNP06 | XTC | XTC/DSPC/Cholesterol/PEG-DMG 57.5/7.5/31.5/3.5 lipid:siRNA ~11:1 |

TABLE A-continued

| Cationic Lipid | | cationic lipid/non-cationic lipid/cholesterol/PEG-lipid conjugate Mol % ratios Lipid:siRNA ratio |
|---|---|---|
| LNP07 | XTC | XTC/DSPC/Cholesterol/PEG-DMG 60/7.5/31/1.5, lipid:siRNA ~6:1 |
| LNP08 | XTC | XTC/DSPC/Cholesterol/PEG-DMG 60/7.5/31/1.5, lipid:siRNA ~11:1 |
| LNP09 | XTC | XTC/DSPC/Cholesterol/PEG-DMG 50/10/38.5/1.5 Lipid:siRNA 10:1 |
| LNP10 | ALN100 | ALN100/DSPC/Cholesterol/PEG-DMG 50/10/38.5/1.5 Lipid:siRNA 10:1 |
| LNP11 | MC3 | MC-3/DSPC/Cholesterol/PEG-DMG 50/10/38.5/1.5 Lipid:siRNA 10:1 |
| LNP12 | C12-200 | C12-200/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA 7:1 |
| LNP22 | XTC | XTC/DSPC/Chol/PEG-DSG 50/10/38.5/1.5 Lipid:siRNA: 10:1 |

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in U.S. Provisional Ser. No. 61/239,686, filed Sep. 3, 2009, and International patent application no. PCT/US10/22614, filed Jan. 29, 2010, which are hereby incorporated by reference.

MC3 comprising formulations are described, e.g., in U.S. Provisional Ser. No. 61/244,834, filed Sep. 22, 2009, and U.S. Provisional Ser. No. 61/185,800, filed Jun. 10, 2009, which are hereby incorporated by reference.

ALN100, i.e., ALNY-100 comprising formulations are described, e.g., International patent application number PCT/US09/63933, filed on Nov. 10, 2009, which is hereby incorporated by reference.

C12-200, i.e., Tech G1 comprising formulations are described in U.S. Provisional Ser. No. 61/175,770, filed May 5, 2009, which is hereby incorporated by reference.

Synthesis of Cationic Lipids.

Any of the compounds, e.g., cationic lipids and the like, used in the nucleic acid-lipid particles of the invention may be prepared by known organic synthesis techniques, including the methods described in more detail in the Examples. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tert-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms may be optionally oxidized, and the nitrogen heteroatom may be optionally quaternized, including bicyclic rings in which any of the above heterocycles are fused to a benzene ring. The heterocycle may be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydroprimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted heterocycle" means that, when substituted, at least one hydrogen atom is replaced with a substituent. In the case of an oxo substituent (=O) two hydrogen atoms are replaced. In this regard, substituents include oxo, halogen, heterocycle, —CN, —ORx, —NRxRy, —NRxC(=O)Ry, —NRxSO2Ry, —C(=O)Rx, —C(=O)ORx, —C(=O)NRxRy, —SOnRx and —SOnNRxRy, wherein n is 0, 1 or 2, Rx and Ry are the same or different and independently hydrogen, alkyl or heterocycle, and each of said alkyl and heterocycle substituents may be further substituted with one or more of oxo, halogen, —OH, —CN, alkyl, —ORx, heterocycle, —NRxRy, NRxC(=O)Ry, —NRxSO2Ry, —C(=O)Rx, —C(=O)ORx, —C(=O)NRxRy, —SOnRx and —SOnNRxRy.

"Halogen" means fluoro, chloro, bromo and iodo.

In some embodiments, the methods of the invention may require the use of protecting groups. Protecting group methodology is well known to those skilled in the art (see, for example, Protective Groups in Organic Synthesis, Green, T.

W. et al., Wiley-Interscience, New York City, 1999). Briefly, protecting groups within the context of this invention are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of Formula A

In one embodiments, nucleic acid-lipid particles of the invention are formulated using a cationic lipid of formula A; XTC is a cationic lipid of formula A:

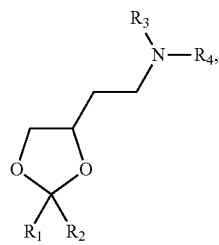

where R1 and R2 are independently alkyl, alkenyl or alkynyl, each can be optionally substituted, and R3 and R4 are independently lower alkyl or R3 and R4 can be taken together to form an optionally substituted heterocyclic ring.

In general, the lipid of formula A above may be made by the following Reaction Schemes 1 or 2, wherein all substituents are as defined above unless indicated otherwise.

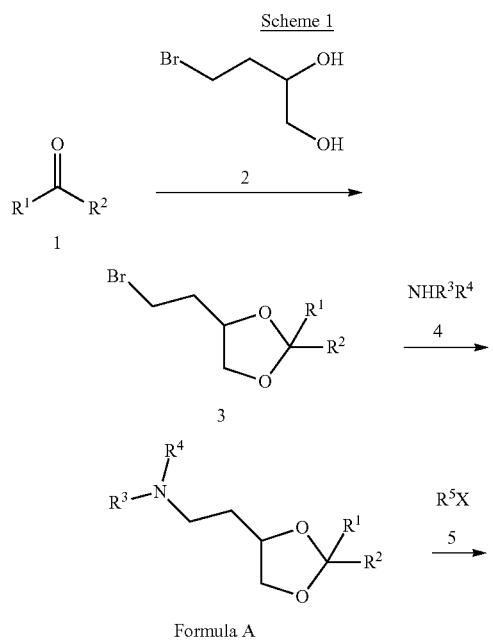

Formula A

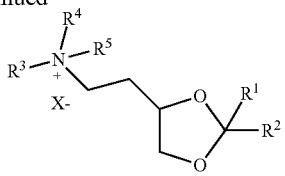

Lipid A, where $R_1$ and $R_2$ are independently alkyl, alkenyl or alkynyl, each can be optionally substituted, and $R_3$ and $R_4$ are independently lower alkyl or $R_3$ and $R_4$ can be taken together to form an optionally substituted heterocyclic ring, can be prepared according to Scheme 1. Ketone 1 and bromide 2 can be purchased or prepared according to methods known to those of ordinary skill in the art. Reaction of 1 and 2 yields ketal 3. Treatment of ketal 3 with amine 4 yields lipids of formula A. The lipids of formula A can be converted to the corresponding ammonium salt with an organic salt of formula 5, where X is anion counter ion selected from halogen, hydroxide, phosphate, sulfate, or the like.

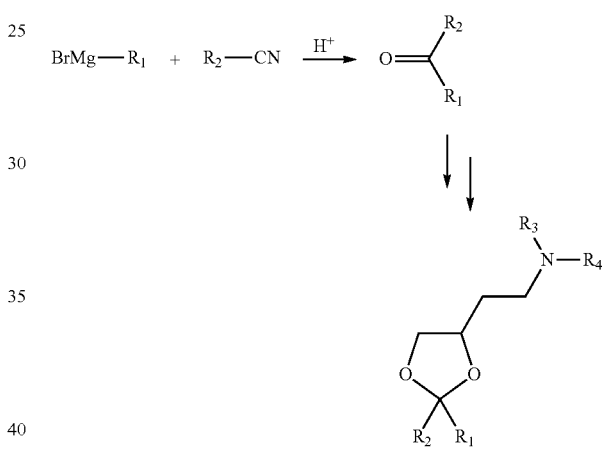

Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of MC3

Preparation of DLin-M-C3-DMA (i.e., (6Z,9Z,28Z,31Z)-heptatriaconta-6,9,28,31-tetraen-19-yl 4-(dimethylamino)butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient. Fractions containing the purified product were combined and the solvent removed, yielding a colorless oil (0.54 g).

Synthesis of ALNY-100

Synthesis of ketal 519 [ALNY-100] was performed using the following scheme 3:

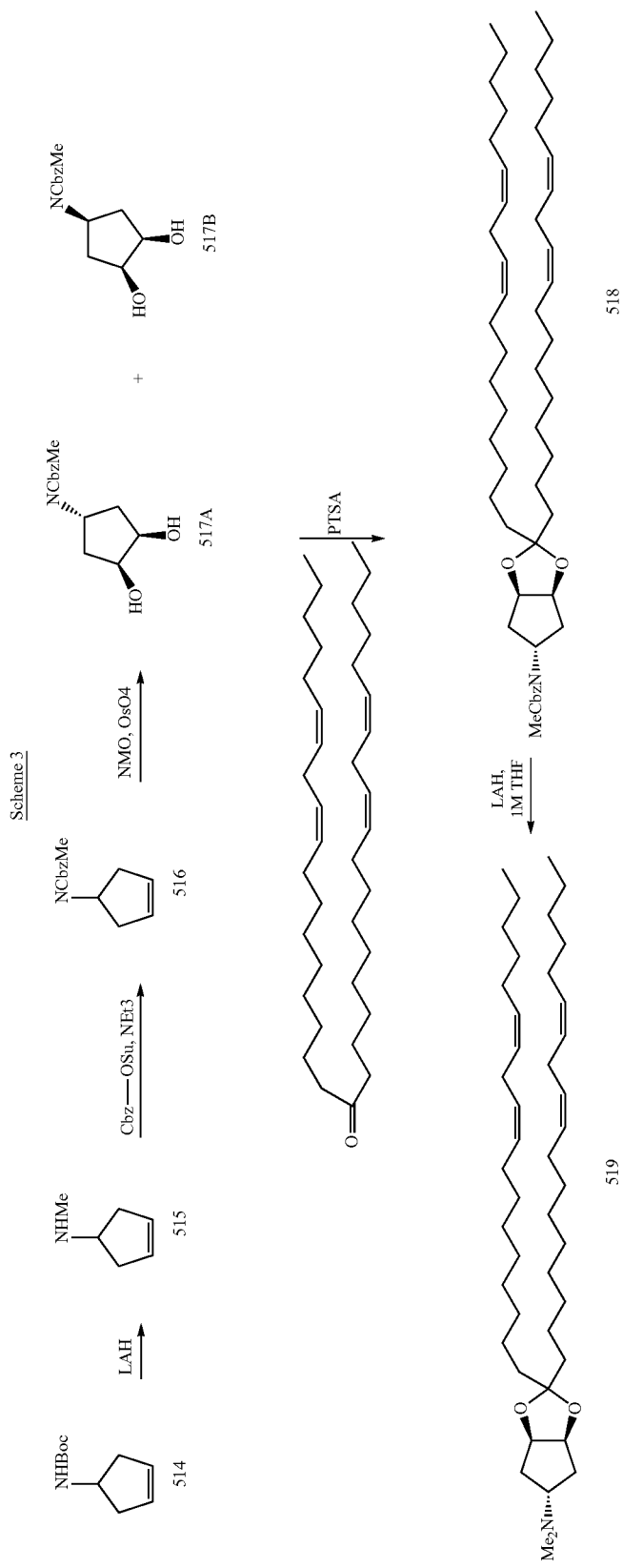

To a stirred suspension of LiAlH4 (3.74 g, 0.09852 mol) in 200 ml anhydrous THF in a two neck RBF (1 L), was added a solution of 514 (10 g, 0.04926 mol) in 70 mL of THF slowly at 0° C. under nitrogen atmosphere. After complete addition, reaction mixture was warmed to room temperature and then heated to reflux for 4 h. Progress of the reaction was monitored by TLC. After completion of reaction (by TLC) the mixture was cooled to 0° C. and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516:

To a stirred solution of compound 515 in 100 mL dry DCM in a 250 mL two neck RBF, was added NEt3 (37.2 mL, 0.2669 mol) and cooled to 0° C. under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated NaHCO3 solution (1×50 mL). The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H]-232.3 (96.94%).

Synthesis of 517A and 517B:

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated NaHCO3 (1×50 mL) solution, water (1×30 mL) and finally with brine (1×50 mL). Organic phase was dried over an.Na2SO4 and solvent was removed in vacuum. Silica gel column chromatographic purification of the crude material was afforded a mixture of diastereomers, which were separated by prep HPLC. Yield: ~6 g crude 517A—Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS—[M+H]-266.3, [M+NH4+]-283.5 present, HPLC-97.86%. Stereochemistry confirmed by X-ray.

Synthesis of 518:

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC-98.65%.

General Procedure for the Synthesis of Compound 519:

A solution of compound 518 (1 eq) in hexane (15 mL) was added in a drop-wise fashion to an ice-cold solution of LAH in THF (1 M, 2 eq). After complete addition, the mixture was heated at 40° C. over 0.5 h then cooled again on an ice bath. The mixture was carefully hydrolyzed with saturated aqueous Na2SO4 then filtered through celite and reduced to an oil. Column chromatography provided the pure 519 (1.3 g, 68%) which was obtained as a colorless oil. 13C NMR □=130.2, 130.1 (×2), 127.9 (×3), 112.3, 79.3, 64.4, 44.7, 38.3, 35.4, 31.5, 29.9 (×2), 29.7, 29.6 (×2), 29.5 (×3), 29.3 (×2), 27.2 (×3), 25.6, 24.5, 23.3, 226, 14.1; Electrospray MS (+ve): Molecular weight for C44H80NO2 (M+H)+Calc. 654.6. Found 654.6.

General Synthesis of Nucleic Acid Lipid Particles

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total dsRNA concentration in the formulation, as well as the entrapped fraction, is estimated using a dye exclusion assay. A sample of the formulated dsRNA can be incubated with an RNA-binding dye, such as Ribogreen (Molecular Probes) in the presence or absence of a formulation disrupting surfactant, e.g., 0.5% Triton-X100. The total dsRNA in the formulation can be determined by the signal from the sample containing the surfactant, relative to a standard curve. The entrapped fraction is determined by subtracting the "free" dsRNA content (as measured by the signal in the absence of surfactant) from the total dsRNA content. Percent entrapped dsRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Other Formulations

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the invention are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention may be delivered orally, in granular form including sprayed dried particles, or complexed to form micro or nanoparticles. DsRNA complexing agents include poly-amino acids; poly-imines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Additional Formulations

Emulsions

The compositions of the present invention may be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.). New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: non-ionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of iRNAs and nucleic acids are formulated as microemulsions. A microemulsion may be defined as a system of water, oil and amphiphile which is a single optically isotropic and thermodynamically stable liquid solution (see e.g., Ansel's Pharmaceutical Dosage Forms and Drug Delivery Systems. Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (M0310), hexaglycerol monooleate (PO310), hexaglycerol pentaoleate (PO500), decaglycerol monocaprate (MCA750), decaglycerol monooleate (M0750), decaglycerol sequioleate (SO750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention may also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention may be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Penetration Enhancers

In one embodiment, the present invention employs various penetration enhancers to effect the efficient delivery of nucleic acids, particularly iRNAs, to the skin of animals. Most drugs are present in solution in both ionized and non-ionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care. New York, N.Y., 2002; Lee et al., Critical Reviews in Therapeutic Drug Carrier Systems, 1991, p. 92). Each of the above mentioned classes of penetration enhancers are described below in greater detail.

Surfactants:

In connection with the present invention, surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care. New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Fatty Acids:

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcamitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile Salts:

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents:

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines) (see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-Chelating Non-Surfactants:

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers include, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of iRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPass$^a$ D1 Transfection Reagent (New England Biolabs; Ipswich, Mass., USA), LyoVec™/LipoGen™ (Invivogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183).

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances that increase the viscosity of the suspension including, for example, sodium carboxymethylcellulose, sorbitol and/or dextran. The suspension may also contain stabilizers.

In some embodiments, pharmaceutical compositions featured in the invention include (a) one or more iRNA compounds and (b) one or more biologic agents which function by a non-RNAi mechanism. Examples of such biologics include, biologics that target one or more of PD-1, PD-L1, or B7-H1 (CD80) (e.g., monoclonal antibodies against PD-1, PD-L1, or B7-H1), or one or more recombinant cytokines (e.g., IL6, IFN-γ, and TNF).

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the dual targeting siRNAs featured in the invention can be administered in combination with other known agents effective in treatment of pathological processes mediated by PCSK9 expression. In any event, the administering physician can adjust the amount and timing of iRNA administration on the basis of results observed using standard measures of efficacy known in the art or described herein.

Methods Using Dual Targeting siRNAs

In one aspect, the invention provides use of a dual targeting siRNA agent for inhibiting the expression of the PCSK9 gene in a mammal. The method includes administering a composition of the invention to the mammal such that expression of the target PCSK9 gene is decreased. In some embodiments, PCSK9 expression is decreased for an extended duration, e.g., at least one week, two weeks, three weeks, or four weeks or longer. For example, in certain instances, expression of the PCSK9 gene is suppressed by at least about 5%, 10%, 15%, 20%, 25%, 30%, 35%, 40%, 45%, or 50% by administration of a dual targeting siRNA agent described herein. In some embodiments, the PCSK9 gene is suppressed by at least about 60%, 70%, or 80% by administration of the dual targeting siRNA agent. In some embodiments, the PCSK9 gene is suppressed by at least about 85%, 90%, or 95% by administration of the double-stranded oligonucleotide.

The methods and compositions described herein can be used to treat diseases and conditions that can be modulated by down regulating PCSK9 gene expression. For example, the compositions described herein can be used to treat hyperlipidemia and other forms of lipid imbalance such as hypercholesterolemia, hypertriglyceridemia and the pathological conditions associated with these disorders such as heart and circulatory diseases Therefore, the invention also relates to the use of a dual targeting siRNA agent for the treatment of a PCSK9-mediated disorder or disease. For example, a dual targeting siRNA agent is used for treatment of a hyperlipidemia.

The effect of the decreased PCSK9 gene preferably results in a decrease in LDLc (low density lipoprotein cholesterol) levels in the blood, and more particularly in the serum, of the mammal. In some embodiments, LDLc levels are decreased by at least 10%, 15%, 20%, 25%, 30%, 40%, 50%, or 60%, or more, as compared to pretreatment levels.

The method includes administering a dual targeting siRNA agent to the subject to be treated. When the organism to be treated is a mammal such as a human, the composition can be administered by any means known in the art including, but not limited to oral or parenteral routes, including intravenous, intramuscular, subcutaneous, transdermal, and airway (aerosol) administration. In some embodiments, the compositions are administered by intravenous infusion or injection.

The method includes administering a dual targeting siRNA agent, e.g., a dose sufficient to depress levels of PCSK9 mRNA for at least 5, more preferably 7, 10, 14, 21, 25, or 40 days; and optionally, administering a second single dose of dsRNA, wherein the second single dose is administered at least 5, more preferably 7, 10, 14, 21, 25, 30 or 40 days after the first single dose is administered, thereby inhibiting the expression of the PCSK9 gene in a subject.

In one embodiment, doses of dual targeting siRNA agent are administered not more than once every four weeks, not more than once every three weeks, not more than once every two weeks, or not more than once every week. In another embodiment, the administrations can be maintained for one, two, three, or six months, or one year or longer.

In another embodiment, administration can be provided when Low Density Lipoprotein cholesterol (LDLc) levels reach or surpass a predetermined minimal level, such as greater than 70 mg/dL, 130 mg/dL, 150 mg/dL, 200 mg/dL, 300 mg/dL, or 400 mg/dL.

In general, the dual targeting siRNA agent does not activate the immune system, e.g., it does not increase cytokine levels, such as TNF-alpha or IFN-alpha levels. For example, when measured by an assay, such as an in vitro PBMC assay, such as described herein, the increase in levels of TNF-alpha or IFN-alpha, is less than 30%, 20%, or 10% of control cells treated with a control dsRNA, such as a dsRNA that does not target PCSK9.

For example, a subject can be administered a therapeutic amount of dual targeting siRNA agent, such as 0.5 mg/kg, 1.0 mg/kg, 1.5 mg/kg, 2.0 mg/kg, or 2.5 mg/kg dsRNA. The dual targeting siRNA agent can be administered by intravenous infusion over a period of time, such as over a 5 minute, 10 minute, 15 minute, 20 minute, or 25 minute period. The administration is repeated, for example, on a regular basis, such as biweekly (i.e., every two weeks) for one month, two months, three months, four months or longer. After an initial treatment regimen, the treatments can be administered on a less frequent basis. For example, after administration biweekly for three months, administration can be repeated once per month, for six months or a year or longer. Administration of the dual targeting siRNA agent can reduce PCSK9 levels, e.g., in a cell, tissue, blood, urine or other compartment of the patient by at least 10%, at least 15%, at least 20%, at least 25%, at least 30%, at least 40%, at least 50%, at least 60%, at least 70%, at least 80% or at least 90% or more.

Before administration of a full dose of the iRNA, patients can be administered a smaller dose, such as a 5% infusion reaction, and monitored for adverse effects, such as an allergic reaction, or for elevated lipid levels or blood pressure. In another example, the patient can be monitored for unwanted immunostimulatory effects, such as increased cytokine (e.g., TNF-alpha or INF-alpha) levels.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given dual targeting siRNA agent drug or formulation of that drug can also be judged using an experimental animal model for the given disease as known in the art. When using an experimental animal model, efficacy of treatment is evidenced when a statistically significant reduction in a marker or symptom is observed.

Additional Agents

In further embodiments, administration of a dual targeting siRNA agent is administered in combination an additional therapeutic agent. The dual targeting siRNA agent and an additional therapeutic agent can be administered in combination in the same composition, e.g., parenterally, or the additional therapeutic agent can be administered as part of a separate composition or by another method described herein.

Examples of additional therapeutic agents include those known to treat an agent known to treat a lipid disorders, such as hypercholesterolemia, atherosclerosis or dyslipidemia. For example, a dual targeting siRNA agent featured in the invention can be administered with, e.g., an HMG-CoA reductase inhibitor (e.g., a statin), a fibrate, a bile acid sequestrant, niacin, an antiplatelet agent, an angiotensin converting enzyme inhibitor, an angiotensin II receptor antagonist (e.g., losartan potassium, such as Merck & Co.'s Cozaar)), an acyl-CoA cholesterol acetyltransferase (ACAT) inhibitor, a cholesterol absorption inhibitor, a cholesterol ester transfer protein (CETP) inhibitor, a microsomal triglyceride transfer protein (MTTP) inhibitor, a cholesterol modulator, a bile acid modulator, a peroxisome proliferation activated receptor (PPAR) agonist, a gene-based therapy, a composite vascular protectant (e.g., AGI-1067, from Atherogenics), a glycoprotein IIb/IIIa inhibitor, aspirin or an aspirin-like compound, an IBAT inhibitor (e.g., S-8921, from Shionogi), a squalene synthase inhibitor, or a monocyte chemoattractant protein (MCP)-I inhibitor. Exemplary HMG-CoA reductase inhibitors include atorvastatin (Pfizer's Lipitor®/Tahor/Sortis/Torvast/Cardyl), pravastatin (Bristol-Myers Squibb's Pravachol, Sankyo's MevalotinlSanaprav), simvastatin (Merck's Zocor®/Sinvacor, Boehringer Ingelheim's Denan, Banyu's Lipovas), lovastatin (Merck's Mevacor/Mevinacor, Bexal's Lovastatina, Cepa; Schwarz Pharma's Liposcler), fluvastatin (Novartis' Lescol®/Locol/Lochol, Fujisawa's Cranoc, Solvay's Digaril), cerivastatin (Bayer's Lipobay/Glaxo-SmithKline's Baycol), rosuvastatin (AstraZeneca's Crestor®), and pitivastatin (itavastatin/risivastatin) (Nissan Chemical, Kowa Kogyo, Sankyo, and Novartis). Exemplary fibrates include, e.g., bezafibrate (e.g., Roche's Befizal®/iCedur/Bezalip®, Kissei's Bezatol), clofibrate (e.g., Wyeth's Atromid-S®), fenofibrate (e.g., Fournier's Lipidil/Lipantil, Abbott's Tricor®, Takeda's Lipantil, generics), gemfibrozil (e.g., Pfizer's Lopid/Lipur) and ciprofibrate (Sanofi-Synthelabo's Modalim®). Exemplary bile acid sequestrants include, e.g., cholestyramine (Bristol-Myers Squibb's Questran® and Questran Light™), colestipol (e.g., Pharmacia's Colestid), and colesevelam (Genzyme/Sankyo's WelChol™). Exemplary niacin therapies include, e.g., immediate release formulations, such as Aventis' Nicobid. Upsher-Smith's Niacor, Aventis' Nicolar, and Sanwakagaku's Perycit. Niacin extended release formulations include, e.g., Kos Pharmaceuticals' Niaspan and Upsher-Smith's Slo-Niacin. Exemplary antiplatelet agents include, e.g., aspirin (e.g., Bayer's aspirin), clopidogrel (Sanofi-Synthelabo/Bristol-Myers Squibb's Plavix), and ticlopidine (e.g., Sanofi-Synthelabo's Ticlid and Daiichi's Panaldine). Other aspirin-like compounds useful in combination with a dsRNA targeting PCSK9 include, e.g., Asacard (slow-release aspirin, by Pharmacia) and Pamicogrel (Kanebo/Angelini Ricerche/CEPA). Exemplary angiotensin-converting enzyme inhibitors include, e.g., ramipril (e.g., Aventis' Altace) and enalapril (e.g., Merck & Co.'s Vasotec). Exemplary acyl CoA cholesterol acetyltransferase (ACAT) inhibitors include, e.g., avasimibe (Pfizer), eflucimibe (BioMérieux Pierre Fabre/Eli Lilly), CS-505 (Sankyo and Kyoto), and SMP-797 (Sumito). Exemplary cholesterol absorption inhibitors include, e.g., ezetimibe (Merck/Schering-Plough Pharmaceuticals Zetia®)

and Pamaqueside (Pfizer). Exemplary CETP inhibitors include, e.g., Torcetrapib (also called CP-529414, Pfizer), JTT-705 (Japan Tobacco), and CETi-I (Avant Immunotherapeutics). Exemplary microsomal triglyceride transfer protein (MTTP) inhibitors include, e.g., implitapide (Bayer), R-103757 (Janssen), and CP-346086 (Pfizer). Other exemplary cholesterol modulators include, e.g., NO-1886 (Otsuka/ TAP Pharmaceutical), CI-1027 (Pfizer), and WAY-135433 (Wyeth-Ayerst). Exemplary bile acid modulators include, e.g., HBS-107 (Hisamitsu/Banyu), Btg-511 (British Technology Group), BARI-1453 (Aventis), S-8921 (Shionogi), SD-5613 (Pfizer), and AZD-7806 (AstraZeneca). Exemplary peroxisome proliferation activated receptor (PPAR) agonists include, e.g., tesaglitazar (AZ-242) (AstraZeneca), Netoglitazone (MCC-555) (Mitsubishi/Johnson & Johnson), GW-409544 (Ligand Pharmaceuticals/GlaxoSmithKline), GW-501516 (Ligand Pharmaceuticals/GlaxoSmithKline), LY-929 (Ligand Pharmaceuticals and Eli Lilly), LY-465608 (Ligand Pharmaceuticals and Eli Lilly), LY-518674 (Ligand Pharmaceuticals and Eli Lilly), and MK-767 (Merck and Kyorin). Exemplary gene-based therapies include, e.g., AdGWEGF121.10 (GenVec), ApoA1 (UCB Pharma/Groupe Fournier), EG-004 (Trinam) (Ark Therapeutics), and ATP-binding cassette transporter—A1 (ABCAI) (CV Therapeutics/Incyte, Aventis, Xenon). Exemplary Glycoprotein IIb/IIIa inhibitors include, e.g., roxifiban (also called DMP754, Bristol-Myers Squibb), Gantofiban (Merck KGaA/Yamanouchi), and Cromafiban (Millennium Pharmaceuticals). Exemplary squalene synthase inhibitors include, e.g., BMS-1884941 (Bristol-Myers Squibb), CP-210172 (Pfizer), CP-295697 (Pfizer), CP-294838 (Pfizer), and TAK-475 (Takeda). An exemplary MCP-I inhibitor is, e.g., RS-504393 (Roche Bioscience). The anti-atherosclerotic agent BO-653 (Chugai Pharmaceuticals), and the nicotinic acid derivative Nyclin (Yamanouchi Pharmacuticals) are also appropriate for administering in combination with a dsRNA featured in the invention. Exemplary combination therapies suitable for administration with a dsRNA targeting PCSK9 include, e.g., advicor (Niacin/lovastatin from Kos Pharmaceuticals), amlodipine/atorvastatin (Pfizer), and ezetimibe/simvastatin (e.g., Vytorin® 10/10, 10/20, 10/40, and 10/80 tablets by Merck/Schering-Plough Pharmaceuticals). Agents for treating hypercholesterolemia, and suitable for administration in combination with a dsRNA targeting PCSK9 include, e.g., lovastatin, niacin Altoprev® Extended-Release Tablets (Andrx Labs), lovastatin Caduet® Tablets (Pfizer), amlodipine besylate, atorvastatin calcium Crestor® Tablets (AstraZeneca), rosuvastatin calcium Lescol® Capsules (Novartis), fluvastatin sodium Lescol® (Reliant, Novartis), fluvastatin sodium Lipitor® Tablets (Parke-Davis), atorvastatin calcium Lofibra® Capsules (Gate), Niaspan Extended-Release Tablets (Kos), niacin Pravachol Tablets (Bristol-Myers Squibb), pravastatin sodium TriCor® Tablets (Abbott), fenofibrate Vytorin® 10/10 Tablets (Merck/Schering-Plough Pharmaceuticals), ezetimibe, simvastatin WelChol™ Tablets (Sankyo), colesevelam hydrochloride Zetia® Tablets (Schering), ezetimibe Zetia® Tablets (Merck/Schering-Plough Pharmaceuticals), and ezetimibe Zocor® Tablets (Merck).

In one embodiment, a dual targeting siRNA agent is administered in combination with an ezetimibe/simvastatin combination (e.g., Vytorin® (Merck/Schering-Plough Pharmaceuticals)).

In one embodiment, the dual targeting siRNA agent is administered to the patient, and then the additional therapeutic agent is administered to the patient (or vice versa). In another embodiment, the dual targeting siRNA agent and the additional therapeutic agent are administered at the same time.

In another aspect, the invention features, a method of instructing an end user, e.g., a caregiver or a subject, on how to administer a dual targeting siRNA agent described herein. The method includes, optionally, providing the end user with one or more doses of the dual targeting siRNA agent, and instructing the end user to administer the dual targeting siRNA agent on a regimen described herein, thereby instructing the end user.

Identification of Patients

In one aspect, the invention provides a method of treating a patient by selecting a patient on the basis that the patient is in need of LDL lowering, LDL lowering without lowering of HDL, ApoB lowering, or total cholesterol lowering. The method includes administering to the patient a dual targeting siRNA agent in an amount sufficient to lower the patient's LDL levels or ApoB levels, e.g., without substantially lowering HDL levels.

Genetic predisposition plays a role in the development of target gene associated diseases, e.g., hyperlipidemia. Therefore, a patient in need of a dual targeting siRNA agent can be identified by taking a family history, or, for example, screening for one or more genetic markers or variants. A healthcare provider, such as a doctor, nurse, or family member, can take a family history before prescribing or administering a dual targeting siRNA agent. For example, a DNA test may also be performed on the patient to identify a mutation in the PCSK9 gene, before a PCSK9 dsRNA is administered to the patient.

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1 iRNA Synthesis

Source of Reagents

Where the source of a reagent is not specifically given herein, such reagent may be obtained from any supplier of reagents for molecular biology at a quality/purity standard for application in molecular biology.

Oligonucleotide Synthesis.

All oligonucleotides are synthesized on an AKTAoligopilot synthesizer. Commercially available controlled pore glass solid support (dT-CPG, 500 Å, Prime Synthesis) and RNA phosphoramidites with standard protecting groups, 5'-O-dimethoxytrityl N6-benzoyl-2'-t-butyldimethylsilyl-adenosine-3'-O—N,N'-diisopropyl-2-cyanoethylphosphoramidite, 5'-O-dimethoxytrityl-N4-acetyl-2'-t-butyldimethylsilyl-cytidine-3'-O—N,N'-diisopropyl-2-cyanoethylphosphoramidite, 5'-O-dimethoxytrityl-N2-isobutryl-2'-t-butyldimethylsilyl-guanosine-3'-O—N,N'-diisopropyl-2-cyanoethylphosphoramidite, and 5'-O-dimethoxytrityl-2'-t- butyldimethylsilyl-uridine-3'-O—N,N'-diisopropyl-2-cyanoethylphosphoramidite (Pierce Nucleic Acids Technologies) were used for the oligonucleotide synthesis. The 2'-F phosphoramidites, 5'-O-dimethoxytrityl-N4-acetyl-2'-fluoro-cytidine-3'-O—N,N'-diisopropyl-2-cyanoethyl-phosphoramidite and 5'-O-dimethoxytrityl-2'-fluoro-uridine-3'-O—N,N-diisopropyl-2-cyanoethyl-phosphoramidite are purchased from (Promega). All phosphoramidites are used at a concentration of 0.2M in acetonitrile ($CH_3CN$) except for guanosine which is used at 0.2M concentration in 10% THF/ANC (v/v). Coupling/recycling time of 16 minutes is used. The activator is 5-ethyl thiotetrazole (0.75M, American International Chemicals); for the PO-oxidation iodine/water/pyridine is used and for the PS-oxidation PADS (2%) in 2,6-lutidine/ACN (1:1 v/v) is used.

3'-ligand conjugated strands are synthesized using solid support containing the corresponding ligand. For example, the introduction of cholesterol unit in the sequence is performed from a hydroxyprolinol-cholesterol phosphoramidite. Cholesterol is tethered to trans-4-hydroxyprolinol via a 6-aminohexanoate linkage to obtain a hydroxyprolinol-cholesterol moiety. 5'-end Cy-3 and Cy-5.5 (fluorophore) labeled iRNAs are synthesized from the corresponding Quasar-570 (Cy-3) phosphoramidite are purchased from Biosearch Technologies. Conjugation of ligands to 5'-end and or internal position is achieved by using appropriately protected ligand-phosphoramidite building block. An extended 15 min coupling of 0.1 M solution of phosphoramidite in anhydrous $CH_3CN$ in the presence of 5-(ethylthio)-1H-tetrazole activator to a solid-support-bound oligonucleotide. Oxidation of the internucleotide phosphite to the phosphate is carried out using standard iodine-water as reported (1) or by treatment with tert-butyl hydroperoxideiacetonitrile/water (10:87:3) with min oxidation wait time conjugated oligonucleotide. Phosphorothioate is introduced by the oxidation of phosphite to phosphorothioate by using a sulfur transfer reagent such as DDTT (purchased from AM Chemicals), PADS and or Beaucage reagent. The cholesterol phosphoramidite is synthesized in house and used at a concentration of 0.1 M in dichloromethane. Coupling time for the cholesterol phosphoramidite is 16 minutes.

Deprotection I (Nucleobase Deprotection)

After completion of synthesis, the support is transferred to a 100 mL glass bottle (VWR). The oligonucleotide is cleaved from the support with simultaneous deprotection of base and phosphate groups with 80 mL of a mixture of ethanolic ammonia [ammonia:ethanol (3:1)] for 6.5 h at 55° C. The bottle is cooled briefly on ice and then the ethanolic ammonia mixture is filtered into a new 250-mL bottle. The CPG is washed with 2×40 mL portions of ethanol/water (1:1 v/v). The volume of the mixture is then reduced to ~30 mL by roto-vap. The mixture is then frozen on dry ice and dried under vacuum on a speed vac.

Deprotection II (Removal of 2'-TBDMS Group)

The dried residue is resuspended in 26 mL of triethylamine, triethylamine trihydrofluoride (TEA.3HF) or pyridine-HF and DMSO (3:4:6) and heated at 60° C. for 90 minutes to remove the tert-butyldimethylsilyl (TBDMS) groups at the 2' position. The reaction is then quenched with 50 mL of 20 mM sodium acetate and the pH is adjusted to 6.5. Oligonucleotide is stored in a freezer until purification.

Analysis

The oligonucleotides are analyzed by high-performance liquid chromatography (HPLC) prior to purification and selection of buffer and column depends on nature of the sequence and or conjugated ligand.

HPLC Purification

The ligand-conjugated oligonucleotides are purified by reverse-phase preparative HPLC. The unconjugated oligonucleotides are purified by anion-exchange HPLC on a TSK gel column packed in house. The buffers are 20 mM sodium phosphate (pH 8.5) in 10% $CH_3CN$ (buffer A) and 20 mM sodium phosphate (pH 8.5) in 10% $CH_3CN$, 1M NaBr (buffer B). Fractions containing full-length oligonucleotides are pooled, desalted, and lyophilized. Approximately 0.15 OD of desalted oligonucleotidess are diluted in water to 150 µL and then pipetted into special vials for CGE and LC/MS analysis. Compounds are then analyzed by LC-ESMS and CGE.

iRNA Preparation

For the general preparation of iRNA, equimolar amounts of sense and antisense strand are heated in 1×PBS at 95° C. for 5 min and slowly cooled to room temperature. Integrity of the duplex is confirmed by HPLC analysis.

Nucleic acid sequences are represented below using standard nomenclature, and specifically the abbreviations of Table B.

TABLE B

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | adenosine |
| C | cytidine |
| G | guanosine |
| U | uridine |
| N | any nucleotide (G, A, C, T or U) |
| a | 2'-O-methyladenosine |
| c | 2'-O-methylcytidine |
| g | 2'-O-methylguanosine |
| u | 2'-O-methyluridine |
| dT, T | 2'-deoxythymidine |
| s | phosphorothioate linkage |

Example 2

PCSK9 siRNA Design. Synthesis, and Screening

A description of the design, synthesis, and assays using PCSK9 siRNA can be found in detail in U.S. patent application Ser. No. 11/746,864 filed on May 10, 2007 (now U.S. Pat. No. 7,605,251) and International Patent Application No. PCT/US2007/068655 filed May 10, 2007 (published as WO 2007/134161) and in U.S. patent application Ser. No. 12/478,452 filed Jun. 4, 2009 (published as US 2010/0010066) and International Patent Application No. PCT/US2009/032743 filed Jan. 30, 2009 (published as WO 2009/134487). All are incorporated by reference in their entirety for all purposes.

The sequences of siRNA targeting a PCSK9 gene are described in Table 1 and Table 2 above, and Tables 4-8 below.

Example 3

XBP-1 siRNA Design, Synthesis, and Screening

A description of the design, synthesis, and assays using XBP-1 siRNA can be found in detail in U.S. patent application Ser. No. 12/425,811 filed on Apr. 17, 2009 and published as US 2009-0275638. This application is incorporated by reference in its entirety for all purposes.

The sequences of siRNA targeting a XBP-1 gene are described in Table 3 above, and Tables 9-13 below.

Example 4

A Dual Targeting siRNA Agent

A dual targeting siRNA agent was synthesized. The sense and antisense strands for AD-10792 (target gene is PCSK9, see Table 2)) and AD-18038 (target gene is XBP-1, see Table 3) were synthesized. The two sense strands were covalently bound using a disulfide linker "Q51" with the structure shown below.

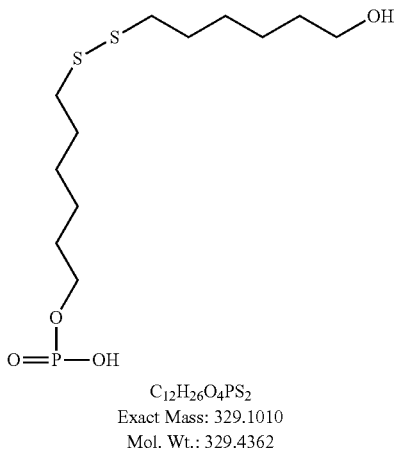

$C_{12}H_{26}O_4PS_2$
Exact Mass: 329.1010
Mol. Wt.: 329.4362

The resulting dual sense strand was hybridized to the corresponding antisense strands to create a 42 mer dual targeting siRNA agent "AD-23426":

GccuGGAGuuuAuucGGAAdTsdTQ51cAcccuGAAuucAuuGucudTs dTdTsdTCGGAcCUCAAAuAAGCCUU dTsdTGUGGGAcUUAAGUAAc

AGA

Example 5

Inhibition of PCSK9 and Xbp-1 mRNA Levels by the PCSK9-Xbp1 Dual Targeting siRNA in Primary Mouse Hepatocytes Primary mouse hepatocytes were transfected with dual targeting AD-23426 or individual siRNAs (AD-10792 and AD-18038) in lipofectamine 2000 (Invitrogen protocol). 48 hours after transfection cells were harvested and lysed. PCSK9, Xbp-1 and GAPDH transcripts were measured via bDNA in cell lysates prepared according to manufacturer's protocol. PCSK9 to GAPDH or Xbp-1 to GAPDH ratios were normalized to control (luciferase) and graphed.

As shown in FIG. 1, the dual targeting siRNA was at least as effective at inhibiting their corresponding target gene as the single siRNAs.

Example 6

Inhibition of PCSK9 and Xbp-1 mRNA Levels and Reduction of Total Serum Cholesterol by the PCSK9-Xbp1 Dual Targeting siRNA in Mice The dual targeting AD-23426 was formulated in an LNP09 formulation: XTC/DSPC/Cholesterol/PEG-DMG in a % mol ratio of 50/10/38.5/1.5 with a lipid:siRNA ratio of about 10:1. The LNP09-AD-23426 was administered by tail vein injection into C57B6 mice at 6.0 mg/kg, 2.0 mg/kg and 0.6 mg/kg. LNP09 formulated single siRNAs (AD-10792 and AD-18038) were administered each at 3.0 mg/kg, 1.0 mg/kg and 0.3 mg/kg. Livers and plasma were harvested 72 hours post-injection (5 animals per group).

Figure 2:
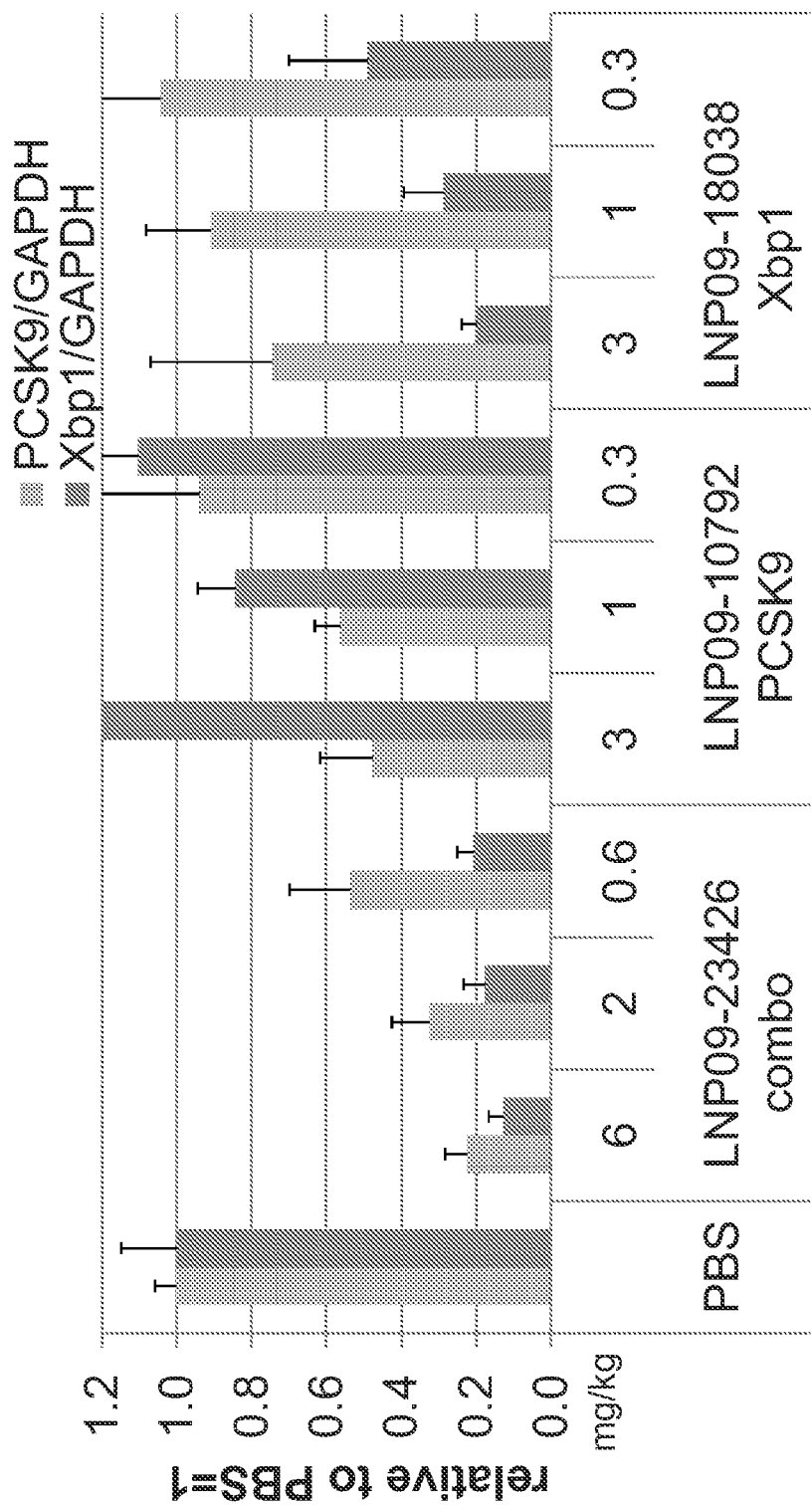
FIG. 2 is a graph showing the effect on PCSK9 and XBP-1 mRNA levels in mice following treatment with a dual targeting siRNA, AD-23426. LNP09 (lipid) formulated siRNA was administered to mice as described. AD-23426 was as effective at reducing mRNA expression as each single gene target siRNA. AD-10792: PCSK9 siRNA. AD-18038: XBP-1 siRNA.
Figure 3:
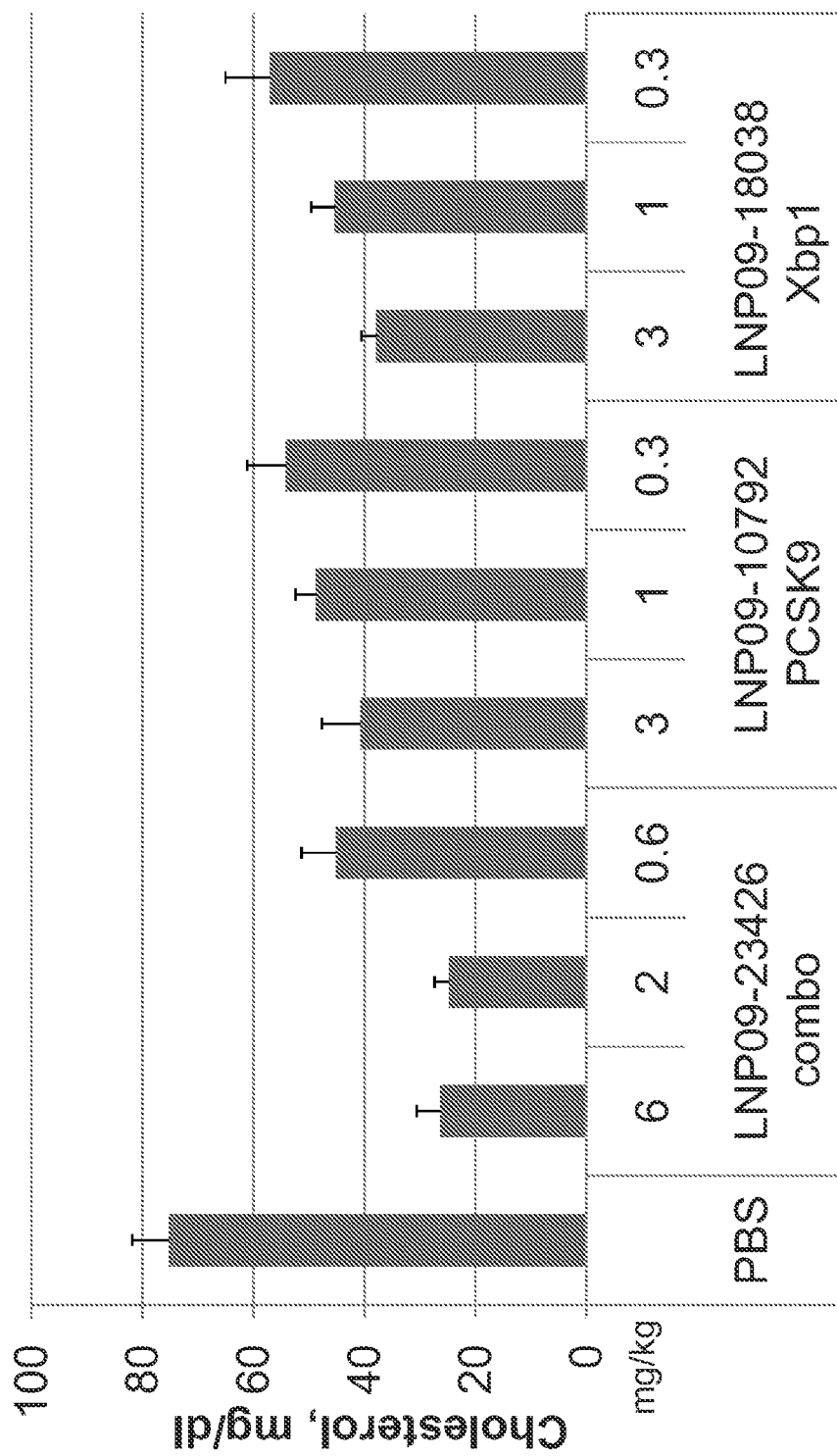
FIG. 3 is a graph showing the effect on serum cholesterol levels in mice following treatment with a dual targeting siRNA, AD-23426. LNP09 (lipid) formulated siRNA was administered to mice as described. AD-23426 was more effective at reducing serum cholesterol compared to each single gene target siRNA. AD-10792: PCSK9 siRNA. AD-18038: XBP-1 siRNA.

PCSK9, Xbp-1 and GAPDH transcript levels were measured via bDNA in livers prepared according to the manufacturer's protocol. PCSK9 to GAPDH or Xbp-1 to GAPDH ratios were normalized to control (luciferase) and graphed. The results are shown in FIG. 2.

Total cholesterol was measure in serum according to manufacturer's instructions using a cholesterol kit from WAKO TX.

The results demonstrate that the dual targeting siRNAs were at least as effective at inhibiting their corresponding target as single siRNAs in vivo. The results also show that the dual targeting construct has an additive effect compared to the single siRNAs at reducing total serum cholesterol.

Example 7

No induction of IFN-α and TNF-α in HuPBMC

The effect of a dual targeting siRNA, AD-23426, on IFN-α and TNF-α in human PBMC was investigated.

Whole Blood anti-coagulated with Sodium Heparin was obtained from healthy donors at Research Blood Components, Inc (Boston, Mass.). Peripheral blood mononuclear cells (PBMC) were isolated by standard Ficoll-Hypaque density centrifugation. Isolated PBMC were seeded at $1\times10^5$ cells/well in 96 well plates and cultured in RPMI 1640 GlutaMax Medium (Invitrogen) supplemented with 10% heat-inactivated fetal bovine serum and 1% antibiotic/antimycotic (Invitrogen). siRNAs were transfected using DOTAP Transfection Reagent (Roche Applied Science). DOTAP was first diluted in Opti-MEM (Invitrogen) for 5 minutes before mixing with an equal volume of Opti-MEM containing the siRNA. siRNA/transfection reagent complexes were incubated for 15 minutes at room temperature prior to being added to PBMC. siRNAs were transfected at final concentrations of 266 nM, 133 nM or 67 nM using 16 µg/ml, 8 µg/ml or 4 µg/ml DOTAP, respectively. The ratio of siRNA to DOTAP is 16.5 pmol/µg. Transfected PBMC were incubated at 37° C., 5% $CO_2$ for 24 hrs after which supernatants were harvested and stored at −80° C. until analysis. Quantitative cytokine analysis was done using commercially available Instant ELISA Kits for IFN-α (BMS216INST) and TNF-a (BMS223INST); both from Bender MedSystems (Vienna, Austria).

LNP09 and DOTAP formulated siRNAs were administered. Control siRNAs were AD-1730, AD-1955, AD-6248, AD-18889, AD-5048, and AD-18221. AD-10792: PCSK9 siRNA. AD-18038: XBP-1 siRNA.

Figure 4B:
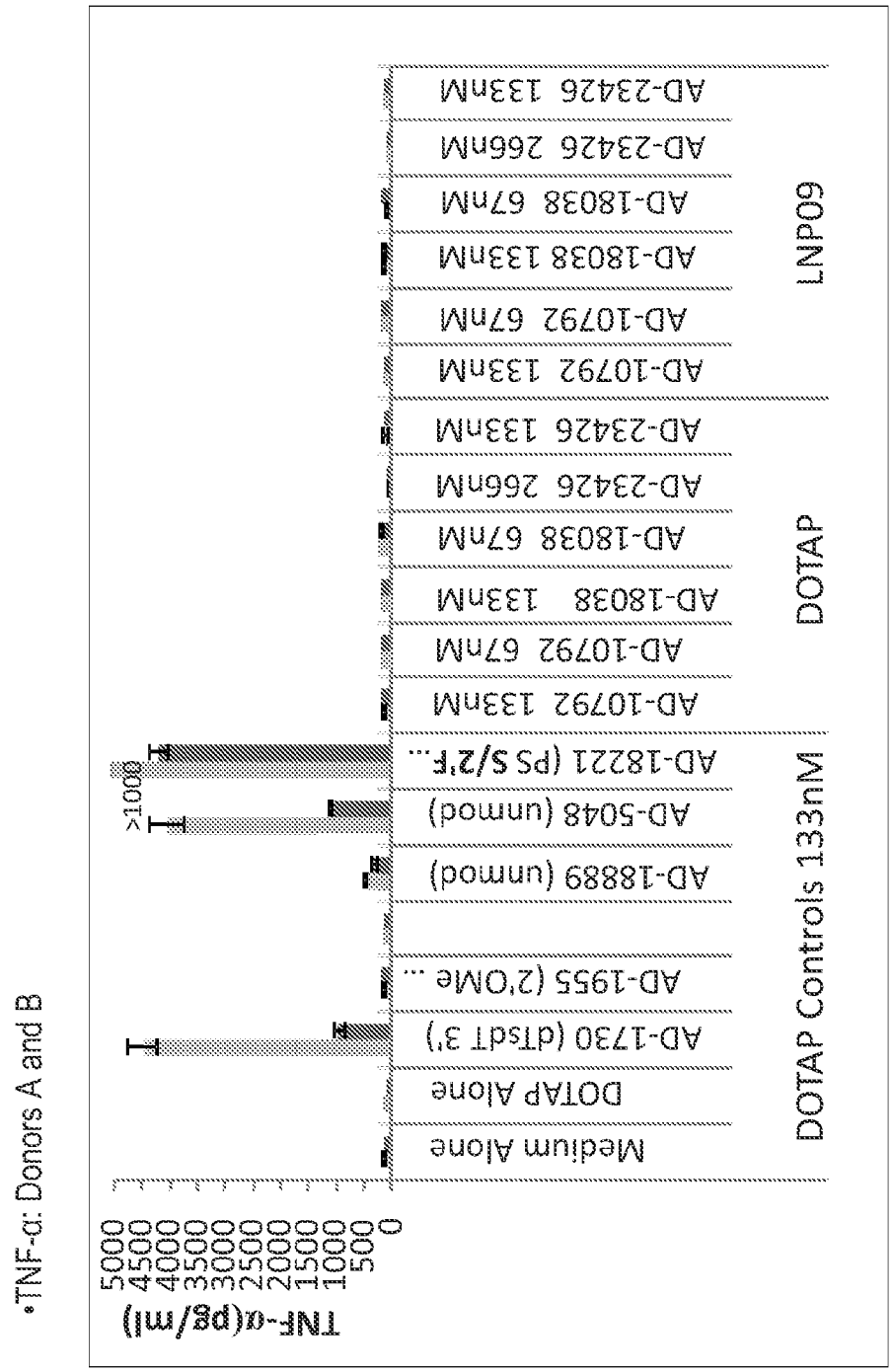
FIG. 4 is a graph showing the effect on IFN-α (FIG. 4A) and TNF-α (FIG. 4B) in human PBMC following treatment with a dual targeting siRNA, AD-23426. DOTAP and LNP09 (lipid) formulated siRNAs was administered huPBMC as described below. AD-23426 did not induce IFN-α TNF-α.

The results are shown in FIG. 4. AD-23426 did not induce production of IFN-α and TNF-α, similar to the result obtained with the single target gene siRNAs. As expected, unmodified siRNAs (AD-5048 and AD-18889) induced production of both IFN-α and TNF-α. These results demonstrate that a dual targeting siRNA does not induce an immune response.

Example 8

Reduction of Total Serum Cholesterol with PCSK9-Xbp1 Dual Targeting siRNA Humans A human subject is treated with a pharmaceutical composition, e.g., a nucleic acid-lipid particle having a dual targeting siRNA agent.

At time zero, a suitable first dose of the pharmaceutical composition is subcutaneously administered to the subject. The composition is formulated as described herein. After a period of time, the subject's condition is evaluated, e.g., by measurement of total serum cholesterol. This measurement can be accompanied by a measurement of PCSK9 expression in said subject, and/or the products of the successful siRNA-targeting of PCSK9 mRNA. Other relevant criteria can also be measured. The number and strength of doses are adjusted according to the subject's needs.

After treatment, the subject's condition is compared to the condition existing prior to the treatment, or relative to the condition of a similarly afflicted but untreated subject.

Those skilled in the art are familiar with methods and compositions in addition to those specifically set out in the present disclosure which will allow them to practice this invention to the full scope of the claims hereinafter appended.

TABLE 4

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 2-20 | AGCGACGUCGAGGCGCUCAUU | 1 | UGAGCGCCUCGACGUCGCUUU | 2 | AD-15220 |
| 15-33 | CGCUCAUGGUUGCAGGCGGUU | 3 | CCGCCUGCAACCAUGAGCGUU | 4 | AD-15275 |
| 16-34 | GCUCAUGGUUGCAGGCGGGUU | 5 | CCCGCCUGCAACCAUGAGCUU | 6 | AD-15301 |
| 30-48 | GCGGGCGCCGCCGUUCAGUUU | 7 | ACUGAACGGCGGCGCCCGCUU | 8 | AD-15276 |
| 31-49 | CGGGCGCCGCCGUUCAGUUUU | 9 | AACUGAACGGCGGCGCCCGUU | 10 | AD-15302 |
| 32-50 | GGGCGCCGCCGUUCAGUUCUU | 11 | GAACUGAACGGCGGCGCCCUU | 12 | AD-15303 |
| 40-58 | CCGUUCAGUUCAGGGUCUGUU | 13 | CAGACCCUGAACUGAACGGUU | 14 | AD-15221 |
| 43-61 | UUCAGUUCAGGGUCUGAGCUU | 15 | GCUCAGACCCUGAACUGAAUU | 16 | AD-15413 |
| 82-100 | GUGAGACUGGCUCGGGCGGUU | 17 | CCGCCCGAGCCAGUCUCACUU | 18 | AD-15304 |
| 100-118 | GGCCGGGACGCGUCGUUGCUU | 19 | GCAACGACGCGUCCCGGCCUU | 20 | AD-15305 |
| 101-119 | GCCGGGACGCGUCGUUGCAUU | 21 | UGCAACGACGCGUCCCGGCUU | 22 | AD-15306 |
| 102-120 | CCGGGACGCGUCGUUGCAGUU | 23 | CUGCAACGACGCGUCCCGGUU | 24 | AD-15307 |
| 105-123 | GGACGCGUCGUUGCAGCAGUU | 25 | CUGCUGCAACGACGCGUCCUU | 26 | AD-15277 |
| 135-153 | UCCCAGCCAGGAUUCCGCGTsT | 27 | CGCGGAAUCCUGGCUGGGAUsT | 28 | AD-9526 |
| 135-153 | ucccAGccAGGAuuccGcGTsT | 29 | CGCGGAAUCCUGGCUGGGAUsT | 30 | AD-9652 |
| 136-154 | CCCAGCCAGGAUUCCGCGCTsT | 31 | GCGCGGAAUCCUGGCUGGGTsT | 32 | AD-9519 |
| 136-154 | cccAGccAGGAuuccGcGcTsT | 33 | GCGCGGAAUCCUGGCUGGGTsT | 34 | AD-9645 |
| 138-156 | CAGCCAGGAUUCCGCGCGCTsT | 35 | GCGCGCGGAAUCCUGGCUGTsT | 36 | AD-9523 |
| 138-156 | cAGccAGGAuuccGcGcGcTsT | 37 | GCGCGCGGAAUCCUGGCUGTsT | 38 | AD-9649 |
| 185-203 | AGCUCCUGCACAGUCCUCCTsT | 39 | GGAGGACUGUGCAGGAGCUsT | 40 | AD-9569 |
| 185-203 | AGcuccuGcAcAGuccuccTsT | 41 | GGAGGACUGUGcAGGAGCUsT | 42 | AD-9695 |
| 205-223 | CACCGCAAGGCUCAAGGCGUU | 43 | CGCCUUGAGCCUUGCGGUGUU | 44 | AD-15222 |
| 208-226 | CGCAAGGCUCAAGGCGCCGUU | 45 | CGGCGCCUUGAGCCUUGCGUU | 46 | AD-15278 |
| 210-228 | CAAGGCUCAAGGCGCCGCCUU | 47 | GGCGGCGCCUUGAGCCUUGUU | 48 | AD-15178 |
| 232-250 | GUGGACCGCGCACGGCCUCUU | 49 | GAGGCCGUGCGCGGUCCACUU | 50 | AD-15308 |
| 233-251 | UGGACCGCGCACGGCCUCUUU | 51 | AGAGGCCGUGCGCGGUCCAUU | 52 | AD-15223 |
| 234-252 | GGACCGCGCACGGCCUCUAUU | 53 | UAGAGGCCGUGCGCGGUCCUU | 54 | AD-15309 |
| 235-253 | GACCGCGCACGGCCUCUAGUU | 55 | CUAGAGGCCGUGCGCGGUCUU | 56 | AD-15279 |
| 236-254 | ACCGCGCACGGCCUCUAGGUU | 57 | CCUAGAGGCCGUGCGCGGUUU | 58 | AD-15194 |
| 237-255 | CCGCGCACGGCCUCUAGGUUU | 59 | ACCUAGAGGCCGUGCGCGGUU | 60 | AD-15310 |
| 238-256 | CGCGCACGGCCUCUAGGUCUU | 61 | GACCUAGAGGCCGUGCGCGUU | 62 | AD-15311 |
| 239-257 | GCGCACGGCCUCUAGGUCUUU | 63 | AGACCUAGAGGCCGUGCGCUU | 64 | AD-15392 |
| 240-258 | CGCACGGCCUCUAGGUCUCUU | 65 | GAGACCUAGAGGCCGUGCGUU | 66 | AD-15312 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 248-266 | CUCUAGGUCUCCUCGCCAGTT | 67 | CUGGCGAGGAGACCUAGAGTT | 68 | AD-15313 |
| 249-267 | UCUAGGUCUCCUCGCCAGGTT | 69 | CCUGGCGAGGAGACCUAGATT | 70 | AD-15280 |
| 250-268 | CUAGGUCUCCUCGCCAGGATT | 71 | UCCUGGCGAGGAGACCUAGTT | 72 | AD-15267 |
| 252-270 | AGGUCUCCUCGCCAGGACATT | 73 | UGUCCUGGCGAGGAGACCUTT | 74 | AD-15314 |
| 258-276 | CCUCGCCAGGACAGCAACCTT | 75 | GGUUGCUGUCCUGGCGAGGTT | 76 | AD-15315 |
| 300-318 | CGUCAGCUCCAGGCGGUCCTsT | 77 | GGACCGCCUGGAGCUGACGTsT | 78 | AD-9624 |
| 300-318 | cGucAGcuccAGGcGGuccTsT | 79 | GGACCGCCUGGAGCUGACGTsT | 80 | AD-9750 |
| 301-319 | GUCAGCUCCAGGCGGUCCUTsT | 81 | AGGACCGCCUGGAGCUGACTsT | 82 | AD-9623 |
| 301-319 | GucAGcuccAGGcGGuccuTsT | 83 | AGGACCGCCUGGAGCUGACTsT | 84 | AD-9749 |
| 370-388 | GGCGCCCGUGCGCAGGAGGTT | 85 | CCUCCUGCGCACGGGCGCCTT | 86 | AD-15384 |
| 408-426 | GGAGCUGGUGCUAGCCUUGTsT | 87 | CAAGGCUAGCACCAGCUCCTsT | 88 | AD-9607 |
| 408-426 | GGAGcuGGuGcuAGccuuGTsT | 89 | cAAGGCuAGcACcAGCUCCTsT | 90 | AD-9733 |
| 411-429 | GCUGGUGCUAGCCUUGCGUTsT | 91 | ACGCAAGGCUAGCACCAGCTsT | 92 | AD-9524 |
| 411-429 | GcuGGuGcuAGccuuGcGuTsT | 93 | ACGcAAGGCuAGcACcAGCTsT | 94 | AD-9650 |
| 412-430 | CUGGUGCUAGCCUUGCGUUTsT | 95 | AACGCAAGGCUAGCACCAGTsT | 96 | AD-9520 |
| 412-430 | CUGGUGCUAGCCUUGCGUUTsT | 97 | AACGCAAGGCUAGCACCAGTsT | 98 | AD-9520 |
| 412-430 | cuGGuGcuAGccuuGcGuuTsT | 99 | AACGcAAGGCuAGcACcAGTsT | 100 | AD-9646 |
| 416-434 | UGCUAGCCUUGCGUUCCGATsT | 101 | UCGGAACGCAAGGCUAGCATsT | 102 | AD-9608 |
| 416-434 | uGcuAGccuuGcGuuccGATsT | 103 | UCGGAACGcAAGGCuAGcATsT | 104 | AD-9734 |
| 419-437 | UAGCCUUGCGUUCCGAGGATsT | 105 | UCCUCGGAACGCAAGGCUATsT | 106 | AD-9546 |
| 419-437 | uAGccuuGcGuuccGAGGATsT | 107 | UCCUCGGAACGcAAGGCuATsT | 108 | AD-9672 |
| 439-459 | GACGGCCUGGCCGAAGCACTT | 109 | GUGCUUCGGCCAGGCCGUCTT | 110 | AD-15385 |
| 447-465 | GGCCGAAGCACCCGAGCACTT | 111 | GUGCUCGGGUGCUUCGGCCTT | 112 | AD-15393 |
| 448-466 | GCCGAAGCACCCGAGCACGTT | 113 | CGUGCUCGGGUGCUUCGGCTT | 114 | AD-15316 |
| 449-467 | CCGAAGCACCCGAGCACGGTT | 115 | CCGUGCUCGGGUGCUUCGGTT | 116 | AD-15317 |
| 458-476 | CCGAGCACGGAACCACAGCTT | 117 | GCUGUGGUUCCGUGCUCGGTT | 118 | AD-15318 |
| 484-502 | CACCGCUGCGCCAAGGAUCTT | 119 | GAUCCUUGGCGCAGCGGUGTT | 120 | AD-15195 |
| 486-504 | CCGCUGCGCCAAGGAUCCGTT | 121 | CGGAUCCUUGGCGCAGCGGTT | 122 | AD-15224 |
| 487-505 | CGCUGCGCCAAGGAUCCGUTT | 123 | ACGGAUCCUUGGCGCAGCGTT | 124 | AD-15188 |
| 489-507 | CUGCGCCAAGGAUCCGUGGTT | 125 | CCACGGAUCCUUGGCGCAGTT | 126 | AD-15225 |
| 500-518 | AUCCGUGGAGGUUGCCUGGTT | 127 | CCAGGCAACCUCCACGGAUTT | 128 | AD-15281 |
| 509-527 | GGUUGCCUGGCACCUACGUTT | 129 | ACGUAGGUGCCAGGCAACCTT | 130 | AD-15282 |
| 542-560 | AGGAGACCCACCUCUCGCATT | 131 | UGCGAGAGGUGGGUCUCCUTT | 132 | AD-15319 |
| 543-561 | GGAGACCCACCUCUCGCAGTT | 133 | CUGCGAGAGGUGGGUCUCCTT | 134 | AD-15226 |
| 544-562 | GAGACCCACCUCUCGCAGUTT | 135 | ACUGCGAGAGGUGGGUCUCTT | 136 | AD-15271 |
| 549-567 | CCACCUCUCGCAGUCAGAGTT | 137 | CUCUGACUGCGAGAGGUGGTT | 138 | AD-15283 |
| 552-570 | CCUCUCGCAGUCAGAGCGCTT | 139 | GCGCUCUGACUGCGAGAGGTT | 140 | AD-15284 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 553-571 | CUCUCGCAGUCAGAGCGCATT | 141 | UGCGCUCUGACUGCGAGAGTT | 142 | AD-15189 |
| 554-572 | UCUCGCAGUCAGAGCGCACTT | 143 | GUGCGCUCUGACUGCGAGATT | 144 | AD-15227 |
| 555-573 | CUCGCAGUCAGAGCGCACUTsT | 145 | AGUGCGCUCUGACUGCGAGTsT | 146 | AD-9547 |
| 555-573 | cucGcAGucAGAGcGcAcuTsT | 147 | AGUGCGCUCUGACUGCGAGTsT | 148 | AD-9673 |
| 558-576 | GCAGUCAGAGCGCACUGCCTsT | 149 | GGCAGUGCGCUCUGACUGCTsT | 150 | AD-9548 |
| 558-576 | GcAGucAGAGcGcAcuGccTsT | 151 | GGcAGUGCGCUCUGACUGCTsT | 152 | AD-9674 |
| 606-624 | GGGAUACCUCACCAAGAUCTsT | 153 | GAUCUUGGUGAGGUAUCCCTsT | 154 | AD-9529 |
| 606-624 | GGGAuAccucAccAAGAucTsT | 155 | GAUCUUGGUGAGGuAUCCCTsT | 156 | AD-9655 |
| 659-677 | UGGUGAAGAUGAGUGGCGATsT | 157 | UCGCCACUCAUCUUCACCATsT | 158 | AD-9605 |
| 659-677 | uGGuGAAGAuGAGuGGcGATsT | 159 | UCGCcACUcAUCUUcACcATsT | 160 | AD-9731 |
| 663-681 | GAAGAUGAGUGGCGACCUGTsT | 161 | CAGGUCGCCACUCAUCUUCTsT | 162 | AD-9596 |
| 663-681 | GAAGAuGAGuGGcGAccuGTsT | 163 | cAGGUCGCcACUcAUCUUCTsT | 164 | AD-9722 |
| 704-722 | CCCAUGUCGACUACAUCGATsT | 165 | UCGAUGUAGUCGACAUGGGTsT | 166 | AD-9583 |
| 704-722 | cccAuGucGAcuAcAucGATsT | 167 | UCGAUGuAGUCGAcAUGGGTsT | 168 | AD-9709 |
| 718-736 | AUCGAGGAGGACUCCUCUGTsT | 169 | CAGAGGAGUCCUCCUCGAUTsT | 170 | AD-9579 |
| 718-736 | AucGAGGAGGAcuccucuGTsT | 171 | cAGAGGAGUCCUCCUCGAUTsT | 172 | AD-9705 |
| 758-776 | GGAACCUGGAGCGGAUUACTT | 173 | GUAAUCCGCUCCAGGUUCCTT | 174 | AD-15394 |
| 759-777 | GAACCUGGAGCGGAUUACCTT | 175 | GGUAAUCCGCUCCAGGUUCTT | 176 | AD-15196 |
| 760-778 | AACCUGGAGCGGAUUACCCTT | 177 | GGGUAAUCCGCUCCAGGUUTT | 178 | AD-15197 |
| 777-795 | CCCUCCACGGUACCGGGCUTT | 179 | CGCCCGGUACCGUGGAGGGTT | 180 | AD-15198 |
| 782-800 | CACGGUACCGGGCGGAUGATsT | 181 | UCAUCCGCCCGGUACCGUGTsT | 182 | AD-9609 |
| 782-800 | cAcGGuAccGGGcGGAuGATsT | 183 | UcAUCCGCCCGGUACCGUGTsT | 184 | AD-9735 |
| 783-801 | ACGGUACCGGGCGGAUGAATsT | 185 | UUCAUCCGCCCGGUACCGUTsT | 186 | AD-9537 |
| 783-801 | AcGGuAccGGGcGGAuGAATsT | 187 | UUcAUCCGCCCGGuACCGUTsT | 188 | AD-9663 |
| 784-802 | CGGUACCGGGCGGAUGAAUTsT | 189 | AUUCAUCCGCCCGGUACCGTsT | 190 | AD-9528 |
| 784-802 | cGGuAccGGGcGGAuGAAuTsT | 191 | AUUcAUCCGCCCGGuACCGTsT | 192 | AD-9654 |
| 785-803 | GGUACCGGGCGGAUGAAUATsT | 193 | UAUUCAUCCGCCCGGUACCTsT | 194 | AD-9515 |
| 785-803 | GGuAccGGGcGAuGAAuATsT | 195 | uAUUcAUCCGCCCGGuACCTsT | 196 | AD-9641 |
| 786-804 | GUACCGGGCGGAUGAAUACTsT | 197 | GUAUUCAUCCGCCCGGUACTsT | 198 | AD-9514 |
| 786-804 | GuAccGGGcGGAuGAAuAcTsT | 199 | GuAUUcAUCCGCCCGGuACTsT | 200 | AD-9640 |
| 788-806 | ACCGGGCGGAUGAAUACCATsT | 201 | UGGUAUUCAUCCGCCCGGUTsT | 202 | AD-9530 |
| 788-806 | AccGGGcGGAuGAAuAccATsT | 203 | UGGuAUUcAUCCGCCCGGUTsT | 204 | AD-9656 |
| 789-807 | CCGGGCGGAUGAAUACCAGTsT | 205 | CUGGUAUUCAUCCGCCCGGTsT | 206 | AD-9538 |
| 789-807 | ccGGGcGGAuGAAuAccAGTsT | 207 | CUGGuAUUcAUCCGCCCGGTsT | 208 | AD-9664 |
| 825-843 | CCUGGUGGAGGUGUAUCUCTsT | 209 | GAGAUACACCUCCACCAGGTsT | 210 | AD-9598 |
| 825-843 | ccuGGuGGAGGuGuAucucTsT | 211 | GAGAuAcACCUCcACcAGGTsT | 212 | AD-9724 |
| 826-844 | CUGGUGGAGGUGUAUCUCCTsT | 213 | GGAGAUACACCUCCACCAGTsT | 214 | AD-9625 |
| 826-844 | cuGGuGGAGGuGuAucuccTsT | 215 | GGAGAuAcACCUCcACcAGTsT | 216 | AD-9751 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 827-845 | UGGUGGAGGUGUAUCUCCUTsT | 217 | AGGAGAUACACCUCCACCATsT | 218 | AD-9556 |
| 827-845 | uGGuGGAGGuGuAucuccuTsT | 219 | AGGAGAuAcACCUCcAccATsT | 220 | AD-9682 |
| 828-846 | GGUGGAGGUGUAUCUCCUATsT | 221 | UAGGAGAUACACCUCCACCTsT | 222 | AD-9539 |
| 828-846 | GGuGGAGGuGuAucuccuATsT | 223 | uAGGAGAuAcACCUCcACCTsT | 224 | AD-9665 |
| 831-849 | GGAGGUGUAUCUCCUAGACTsT | 225 | GUCUAGGAGAUACACCUCCTsT | 226 | AD-9517 |
| 831-849 | GGAGGuGuAucuccuAGAcTsT | 227 | GUCuAGGAGAuAcACCUCCTsT | 228 | AD-9643 |
| 833-851 | AGGUGUAUCUCCUAGACACTsT | 229 | GUGUCUAGGAGAUACACCUTsT | 230 | AD-9610 |
| 833-851 | AGGuGuAucuccuAGAcAcTsT | 231 | GUGUCuAGGAGAuAcACCUTsT | 232 | AD-9736 |
| 833-851 | AfgGfuGfuAfuCfuCfcUfaGfaCfaCfTsT | 233 | P*gUfgUfcUfaGfgAfgAfuAfcAfcCfuTsT | 234 | AD-14681 |
| 833-851 | AGGUfGUfAUfCfUfCfCfUfAGACfACfTsT | 235 | GUfGUfCfUfAGGAGAUfACfACfCfUfTsT | 236 | AD-14691 |
| 833-851 | AgGuGuAuCuCcUaGaCaCTsT | 237 | P*gUfgUfcUfaGfgAfgAfuAfcAfcCfuTsT | 238 | AD-14701 |
| 833-851 | AgGuGuAuCuCcUaGaCaCTsT | 239 | GUfGUfCfUfAGGAGAUfACfACfCfUfTsT | 240 | AD-14711 |
| 833-851 | AfgGfuGfuAfuCfuCfcUfaGfaCfaCfTsT | 241 | GUGUCuaGGagAUACAccuTsT | 242 | AD-14721 |
| 833-851 | AGGUfGUfAUfCfUfCfCfUfAGACfACfTsT | 243 | GUGUCuaGGagAUACAccuTsT | 244 | AD-14731 |
| 833-851 | AgGuGuAuCuCcUaGaCaCTsT | 245 | GUGUCuaGGagAUACAccuTsT | 246 | AD-14741 |
| 833-851 | GfcAfcCfcUfcAfuAfgGfcCfuGfgAfTsT | 247 | P*uCfcAfgGfcCfuAfuGfaGfgUfgCfTsT | 248 | AD-15087 |
| 833-851 | GCfACfCfCfUfCfAUfAGGCfCfUfGGATsT | 249 | UfCfCfAGGCfCfUfAUfGAGGGUfGCfTsT | 250 | AD-15097 |
| 833-851 | GcAcCcUcAuAgGcCuGgATsT | 251 | P*uCfcAfgGfcCfuAfuGfaGfgUfgCfTsT | 252 | AD-15107 |
| 833-851 | GcAcCcUcAuAgGcCuGgATsT | 253 | UfCfCfAGGCfCfUfAUfGAGGGUfGCfTsT | 254 | AD-15117 |
| 833-851 | GfcAfcCfcUfcAfuAfgGfcCfuGfgAfTsT | 255 | UCCAGgcCUauGAGGGugcTsT | 256 | AD-15127 |
| 833-851 | GCfACfCfCfUfCfAUfAGGCfCfUfGGATsT | 257 | UCCAGgcCUauGAGGGugcTsT | 258 | AD-15137 |
| 833-851 | GcAcCcUcAuAgGcCuGgATsT | 259 | UCCAGgcCUauGAGGGugcTsT | 260 | AD-15147 |
| 836-854 | UGUAUCUCCUAGACACCAGTsT | 261 | CUGGUGUCUAGGAGAUACATsT | 262 | AD-9516 |
| 836-854 | uGuAucuccuAGAcAccAGTsT | 263 | CUGGUGUCuAGGAGAuAcATsT | 264 | AD-9642 |
| 840-858 | UCUCCUAGACACCAGCAUATsT | 265 | UAUGCUGGUGUCUAGGAGATsT | 266 | AD-9562 |
| 840-858 | ucuccuAGAcAccAGcAuATsT | 267 | uAUGCUGGUGUCuAGGAGATsT | 268 | AD-9688 |
| 840-858 | UfcUfcCfuAfgAfcAfcCfaGfcAfuAfTsT | 269 | P*uAfuGfcUfgGfuGfuCfuAfgGfaGfaTsT | 270 | AD-14677 |
| 840-858 | UfCfUfCfCfUfAGACfACfCfAGCfAUfATsT | 271 | UfAUfGCfUfGGUfGUfCfUfAGGAGATsT | 272 | AD-14687 |
| 840-858 | UcUcCuAgAcAcCaGcAuATsT | 273 | P*uAfuGfcUfgGfuGfuCfuAfgGfaGfaTsT | 274 | AD-14697 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 840-858 | UcUcCuAgAcAcCaGcAuATsT | 275 | UfAUfGCfUfGGUfGUfCfUfAGGAGATst | 276 | AD-14707 |
| 840-858 | UfcUfcCfuAafAfcAfcCfaGfcAfuAfTsT | 277 | UAUGCugGUguCUAGGagaTsT | 278 | AD-14717 |
| 840-858 | UfCfUfCfCfUfAGACfACfCfAGCfAUfATsT | 279 | UAUGCugGUguCUAGGagaTsT | 280 | AD-14727 |
| 840-858 | UcUcCuAgAcAcCaGcAuATsT | 281 | UAUGCugGUguCUAGGagaTsT | 282 | AD-14737 |
| 840-858 | AfgGfcCfuGfgAfgUfuUfaUfuCfgGfTsT | 283 | P*cCfgAfaUfaAfaCfuCfcAfgGfcCfuTsT | 284 | AD-15083 |
| 840-858 | AGGCfCfUfGGAGUfUfUfAUfUfCfGGTsT | 285 | CfCfGAAUfAAACfUfCfCfAGGCfCfUfTsT | 286 | AD-15093 |
| 840-858 | AgGcCuGgAgUuUaUuCgGTsT | 287 | P*cCfgAfaUfaAfaCfuCfcAfgGfcCfuTsT | 288 | AD-15103 |
| 840-858 | AgGcCuGgAgUuUaUuCgGTsT | 289 | CfCfGAAUfAAACfUfCfCfAGGCfCfUfTsT | 290 | AD-15113 |
| 840-858 | AfgGfcCfuGfgAfgUfuUfaUfuCfgGfTsT | 291 | CCGAAuaAAcuCCAGGccuTsT | 292 | AD-15123 |
| 840-858 | AGGCfCfUfGGAGUfUfUfAUfUfCfGGTsT | 293 | CCGAAuaAAcuCCAGGccuTsT | 294 | AD-15133 |
| 840-858 | AgGcCuGgAgUuUaUuCgGTsT | 295 | CCGAAuaAAcuCCAGGccuTsT | 296 | AD-15143 |
| 841-859 | CUCCUAGACACCAGCAUACTsT | 297 | GUAUGCUGGUGUCUAGGAGTsT | 298 | AD-9521 |
| 841-859 | cuccuAGAcAccAGcAuAcTsT | 299 | GuAUGCUGGUGUCUAGGAGTsT | 300 | AD-9647 |
| 842-860 | UCCUAGACACCAGCAUACATsT | 301 | UGUAUGCUGGUGUCUAGGAGTsT | 302 | AD-9611 |
| 842-860 | uccuAGAcAccAGcAuAcATsT | 303 | UGuAUGCUGGUGUCuAGGATsT | 304 | AD-9737 |
| 843-861 | CCUAGACACCAGCAUACAGTsT | 305 | CUGUAUGCUGGUGUCUAGGTsT | 306 | AD-9592 |
| 843-861 | ccuAGAcAccAGcAuAcAGTsT | 307 | CUGuAUGCUGGUGUCuAGGTsT | 308 | AD-9718 |
| 847-865 | GACACCAGCAUACAGAGUGTsT | 309 | CACUCUGUAUGCUGGUGUCTsT | 310 | AD-9561 |
| 847-865 | GAcAccAGcAuAcAGAGuGTsT | 311 | cACUCUGuAUGCUGGUGUCTsT | 312 | AD-9687 |
| 855-873 | CAUACAGAGUGACCACCGGTsT | 313 | CCGGUGGUCACUCUGUAUGTsT | 314 | AD-9636 |
| 855-873 | cAuAcAGAGuGAccAccGGTsT | 315 | CCGGUGGUcACUCUGuAUGTsT | 316 | AD-9762 |
| 860-878 | AGAGUGACCACCGGGAAAUTsT | 317 | AUUUCCCGGUGGUCACUCUTsT | 318 | AD-9540 |
| 860-878 | AGAGuGAccAccGGGAAAuTsT | 319 | AUUUCCCGGUGGUcACUCUTsT | 320 | AD-9666 |
| 861-879 | GAGUGACCACCGGGAAAUCTsT | 321 | GAUUUCCCGGUGGUCACUCTsT | 322 | AD-9535 |
| 861-879 | GAGuGAccAccGGGAAAucTsT | 323 | GAUUUCCCGGUGGUcACUCTsT | 324 | AD-9661 |
| 863-881 | GUGACCACCGGGAAAUCGATsT | 325 | UCGAUUUCCCGGUGGUCACTsT | 326 | AD-9559 |
| 863-881 | GuGAccAccGGGAAAucGATsT | 327 | UCGAUUUCCCGGUGGUcACTsT | 328 | AD-9685 |
| 865-883 | GACCACCGGGAAAUCGAGGTsT | 329 | CCUCGAUUUCCCGGUGGUCTsT | 330 | AD-9533 |
| 865-883 | GAccAccGGGAAAucGAGGTsT | 331 | CCUCGAUUUCCCGGUGGUCTsT | 332 | AD-9659 |
| 866-884 | ACCACCGGGAAAUCGAGGGTsT | 333 | CCCUCGAUUUCCCGGUGGUTsT | 334 | AD-9612 |
| 866-884 | AccAccGGGAAAucGAGGGTsT | 335 | CCCUCGAUUUCCCGGUGGUTsT | 336 | AD-9738 |
| 867-885 | CCACCGGGAAAucGAGGGCTsT | 337 | GCCCUCGAUUUCCCGGUGGTsT | 338 | AD-9557 |
| 867-885 | ccAccGGGAAAucGAGGGcTsT | 339 | GCCCUCGAUUUCCCGGUGGTsT | 340 | AD-9683 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 875-893 | AAAUCGAGGGCAGGGUCAUTsT | 341 | AUGACCCUGCCCUCGAUUUTsT | 342 | AD-9531 |
| 875-893 | AAAucGAGGGcAGGGUcAuTsT | 343 | AUGACCCUGCCCUCGAUUUTsT | 344 | AD-9657 |
| 875-893 | AfaAfuCfgAfgGfgCfaGfgGfuCfaUfTsT | 345 | P*aUfgAfcCfcUfgCfcCfuCfgAfuUfuTsT | 346 | AD-14673 |
| 875-893 | AAAUfCfGAGGGCfAGGGUfCfAUfTsT | 347 | AUfGACfCfCfUfGCfCfCfUfCfGAUfUfUfTsT | 348 | AD-14683 |
| 875-893 | AaAuCgAgGgCaGgGuCaUTsT | 349 | P*aUfgAfcCfcUfgCfcCfuCfgAfuUfuTsT | 350 | AD-14693 |
| 875-893 | AaAuCgAgGgCaGgGuCaUTsT | 351 | AUfGACfCfCfUfGCfCfCfUfCfGAUfUfUfTsT | 352 | AD-14703 |
| 875-893 | AfaAfuCfgAfgGfgCfaGfgGfuCfaUfTsT | 353 | AUGACccUGccCUCGAuuuTsT | 354 | AD-14713 |
| 875-893 | AAAUfCfGAGGGCfAGGGUfCfAUfTsT | 355 | AUGACccUGccCUCGAuuuTsT | 356 | AD-14723 |
| 875-893 | AaAuCgAgGgCaGgGuCaUTsT | 357 | AUGACccUGccCUCGAuuuTsT | 358 | AD-14733 |
| 875-893 | CfgGfcAfcCfcUfcAfuAfgGfcCfuGfTsT | 359 | P*cAfgGfcCfuAfuGfaGfgGfuGfcCfgTsT | 360 | AD-15079 |
| 875-893 | CfGGCfACfCfCfUfCfAUfAGGCfCfUfGTsT | 361 | CfAGGCfCfUfAUfGAGGGUfGCfCfGTsT | 362 | AD-15089 |
| 875-893 | CgGcAcCcUcAuAgGcCuGTsT | 363 | P*cAfgGfcCfuAfuGfaGfgGfuGfcCfgTsT | 364 | AD-15099 |
| 875-893 | CgGcAcCcUcAuAgGcCuGTsT | 365 | CfAGGCfCfUfAUfGAGGGUfGCfCfGTsT | 366 | AD-15109 |
| 875-893 | CfgGfcAfcCfcUfcAfuAfgGfcCfuGfTsT | 367 | CAGGCcuAUgaGGGUGccgTsT | 368 | AD-15119 |
| 875-893 | CfGGCfACfCfCfUfCfAUfAGGCfCfUfGTsT | 369 | CAGGCcuAUgaGGGUGccgTsT | 370 | AD-15129 |
| 875-893 | CgGcAcCcUcAuAgGcCuGTsT | 371 | CAGGCcuAUgaGGGUGccgTsT | 372 | AD-15139 |
| 877-895 | AUCGAGGGCAGGGUCAUGGTsT | 373 | CCAUGACCCUGCCCUCGAUTsT | 374 | AD-9542 |
| 877-895 | AucGAGGGcAGGGUcAuGGTsT | 375 | CcAUGACCCUGCCCUCGAUTsT | 376 | AD-9668 |
| 878-896 | cGAGGGcAGGGucAuGGucTsT | 377 | GACcAUGACCCUGCCCUCGTsT | 378 | AD-9739 |
| 880-898 | GAGGGCAGGGUCAUGGUCATsT | 379 | UGACCAUGACCCUGCCCUCTsT | 380 | AD-9637 |
| 880-898 | GAGGGcAGGGucAuGGucATsT | 381 | UGAccAUGACCCUGCCCUCTsT | 382 | AD-9763 |
| 882-900 | GGGCAGGGUCAUGGUCACCTsT | 383 | GGUGACCAUGACCCUGCCCTsT | 384 | AD-9630 |
| 882-900 | GGGcAGGGucAUGGucAccTsT | 385 | GGUGAccAUGACCCUGCCCTsT | 386 | AD-9756 |
| 885-903 | CAGGGUCAUGGUCACCGACTsT | 387 | GUCGGUGACCAUGACCCUGTsT | 388 | AD-9593 |
| 885-903 | cAGGGucAuGGucAuuGAcTsT | 389 | GUCGGUGACcAUGACCCUGTsT | 390 | AD-9719 |
| 886-904 | AGGGUCAUGGUCACCGACUTsT | 391 | AGUCGGUGACCAUGACCCUTsT | 392 | AD-9601 |
| 886-904 | AGGGucAuGGucAccGAcuTsT | 393 | AGUCGGUGACcAUGACCCUTsT | 394 | AD-9727 |
| 892-910 | AUGGUCACCGACUUCGAGATsT | 395 | UCUCGAAGUCGGUGACCAUTsT | 396 | AD-9573 |
| 892-910 | AuGGucAccGAcuucGAGATsT | 397 | UCUCGAAGUCGGUGACcAUTsT | 398 | AD-9699 |
| 899-917 | CCGACUUCGAGAAUGUGCUTT | 399 | GGCACAUUCUCGAAGUCGGTT | 400 | AD-15228 |
| 921-939 | GGAGGACGGGACCCGCUUCTT | 401 | GAAGCGGGUCCCGUCCUCCTT | 402 | AD-15395 |

TABLE 4 -continued

Sequences of siRNA targeted to PCSK9

| *Target | Sense strand (5'-3')¹ | SEQ ID NO: | Antisense strand (5'-3')¹ | SEQ ID NO: | Duplex # |
|---|---|---|---|---|---|
| 993-1011 | CAGCGGCCGGGAUGCCGGCTsT | 403 | GCCGGCAUCCCGGCCGCUGTsT | 404 | AD-9602 |
| 993-1011 | cAGcGGccGGGAuGccGGcTsT | 405 | GCCGGcAUCCCGGCCGCUGTsT | 406 | AD-9728 |
| 1020-1038 | GGGUGCCAGCAUGCGCAGCTT | 407 | GCUGCGCAUGCUGGCACCCTT | 408 | AD-15386 |
| 1038-1056 | CCUGCGCGUGCUCAACUGCTsT | 409 | GCAGUUGAGCACGCGCAGGTsT | 410 | AD-9580 |
| 1038-1056 | ccuGcGcGuGcucAAcuGcTsT | 411 | GcAGUUGAGcACGCGcAGGTsT | 412 | AD-9706 |
| 1040-1058 | UGCGCGUGCUCAACUGCCATsT | 413 | UGGCAGUUGAGCACGCGCATsT | 414 | AD-9581 |
| 1040-1058 | uGcGcGuGcucAAcuGccATsT | 415 | UGGcAGUUGAGcACGCGcATsT | 416 | AD-9707 |
| 1042-1060 | CGCGUGCUCAACUGCCAAGTsT | 417 | CUUGGCAGUUGAGCACGCGTsT | 418 | AD-9543 |
| 1042-1060 | cGcGuGcucAAcuGccAAGTsT | 419 | CUUGGcAGUUGAGcACGCGTsT | 420 | AD-9669 |
| 1053-1071 | CUGCCAAGGGAAGGGCACGTsT | 421 | CGUGCCCUUCCCUUGGCAGTsT | 422 | AD-9574 |
| 1053-1071 | cuGccAAGGGAAGGGcAcGTsT | 423 | CGUGCCCUUCCCUUGGcAGTsT | 424 | AD-9700 |
| 1057-1075 | CAAGGGAAGGGCACGGUUATT | 425 | UAACCGUGCCCUUCCCUUGTT | 426 | AD-15320 |
| 1058-1076 | AAGGGAAGGGCACGGUUAGTT | 427 | CUAACCGUGCCCUUCCCUUTT | 428 | AD-15321 |
| 1059-1077 | AGGGAAGGGCACGGUUAGCTT | 429 | GCUAACCGUGCCCUUCCCUTT | 430 | AD-15199 |
| 1060-1078 | GGGAAGGGCACGGUUAGCGTT | 431 | CGCUAACCGUGCCCUUCCCTT | 432 | AD-15167 |
| 1061-1079 | GGAAGGGCACGGUUAGCGGTT | 433 | CCGCUAACCGUGCCCUUCCTT | 434 | AD-15164 |
| 1062-1080 | GAAGGGCACGGUUAGCGGCTT | 435 | GCCGCUAACCGUGCCCUUCTT | 436 | AD-15166 |
| 1063-1081 | AAGGGCACGGUUAGCGGCATT | 437 | UGCCGCUAACCGUGCCCUUTT | 438 | AD-15322 |
| 1064-1082 | AGGGCACGGUUAGCGGCACTT | 439 | GUGCCGCUAACCGUGCCCUTT | 440 | AD-15200 |
| 1068-1086 | CACGGUUAGCGGCACCCUCTT | 441 | GAGGGUGCCGCUAACCGUGTT | 442 | AD-15213 |
| 1069-1087 | ACGGUUAGCGGCACCCUCATT | 443 | UGAGGGUGCCGCUAACCGUTT | 444 | AD-15229 |
| 1072-1090 | GUUAGCGGCACCCUCAUAGTT | 445 | CUAUGAGGGUGCCGCUAACTT | 446 | AD-15215 |
| 1073-1091 | UUAGCGGCACCCUCAUAGGTT | 447 | CCUAUGAGGGUGCCGCUAATT | 448 | AD-15214 |
| 1076-1094 | GCGGCACCCUCAUAGGCCUTsT | 449 | AGGCCUAUGAGGGUGCCGCTsT | 450 | AD-9315 |
| 1079-1097 | GCACCCUCAUAGGCCUGGATsT | 451 | UCCAGGCCUAUGAGGGUGCTsT | 452 | AD-9326 |
| 1085-1103 | UCAUAGGCCUGGAGUUUAUTsT | 453 | AUAAACUCCAGGCCUAUGATsT | 454 | AD-9318 |
| 1090-1108 | GGCCUGGAGUUUAUUCGGATsT | 455 | UCCGAAUAAACUCCAGGCCTsT | 456 | AD-9323 |
| 1091-1109 | GCCUGGAGUUUAUUCGGAATsT | 457 | UUCCGAAUAAACUCCAGGCTsT | 458 | AD-9314 |
| 1091-1109 | GccuGGAGuuuAuucGGAATsT | 459 | UUCCGAAuAAACUCcAGGCTsT | 460 | AD-10792 |
| 1091-1109 | GccuGGAGuuuAuucGGAATsT | 461 | UUCCGAAUAACUCCAGGCTsT | 462 | AD-10796 |
| 1093-1111 | CUGGAGUUUAUUCGGAAAATsT | 463 | UUUUCCGAAUAAACUCCAGTsT | 464 | AD-9638 |
| 1093-1111 | cuGGAGuuuAuucGGAAAATsT | 465 | UUUUCCGAAuAAACUCcAGTsT | 466 | AD-9764 |
| 1095-1113 | GGAGUUUAUUCGGAAAAGCTsT | 467 | GCUUUUCCGAAUAAACUCCTsT | 468 | AD-9525 |
| 1095-1113 | GGAGuuuAuucGGAAAAGcTsT | 469 | GCUUUUCCGAAuAAACUCCTsT | 470 | AD-9651 |
| 1096-1114 | GAGUUUAUUCGGAAAAGCCTsT | 471 | GGCUUUUCCGAAUAAACUCTsT | 472 | AD-9560 |
| 1096-1114 | GAGuuuAuucGGAAAAGccTsT | 473 | GGCUUUUCCGAAuAAACUCTsT | 474 | AD-9686 |
| 1100-1118 | UUAUUCGGAAAAGCCAGCUTsT | 475 | AGCUGGCUUUUCCGAAUAATsT | 476 | AD-9536 |
| 1100-1118 | uuAuucGGAAAAGccAGcuTsT | 477 | AGCUGGCUUUUCCGAAuAATsT | 478 | AD-9662 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 1154-1172 | CCCUGGCGGGUGGGUACAGTsT | 479 | CUGUACCCACCCGCCAGGGTsT | 480 | AD-9584 |
| 1154-1172 | cccuGGcGGGuGGGuAcAGTsT | 481 | CUGuACCcACCCGCcAGGGTsT | 482 | AD-9710 |
| 1155-1173 | CCUGGCGGGUGGGUACAGCTT | 483 | GCUGUACCCACCCGCCAGGTT | 484 | AD-15323 |
| 1157-1175 | UGGCGGGUGGGUACAGCCGTsT | 485 | CGGCUGUACCCACCCGCCATsT | 486 | AD-9551 |
| 1157-1175 | uGGcGGGuGGGuAcAGccGTsT | 487 | CGGCUGuACCcACCCGCcATsT | 488 | AD-9677 |
| 1158-1176 | GGCGGGUGGGUACAGCCGCTT | 489 | GCGGCUGUACCCACCCGCCTT | 490 | AD-15230 |
| 1162-1180 | GGUGGGUACAGCCGCGUCCTT | 491 | GGACGCGGCUGUACCCACCTT | 492 | AD-15231 |
| 1164-1182 | UGGGUACAGCCGCGUCCUCTT | 493 | GAGGACGCGGCUGUACCCATT | 494 | AD-15285 |
| 1172-1190 | GCCGCGUCCUCAACGCCGCTT | 495 | GCGGCGUUGAGGACGCGGCTT | 496 | AD-15396 |
| 1173-1191 | CCGCGUCCUCAACGCCGCCTT | 497 | GGCGGCGUUGAGGACGCGGTT | 498 | AD-15397 |
| 1216-1234 | GUCGUGCUGGUCACCGCUGTsT | 499 | CAGCGGUGACCAGCACGACTsT | 500 | AD-9600 |
| 1216-1234 | GucGuGcuGGucAccGcuGTsT | 501 | cAGCGGUGACcAGcACGACTsT | 502 | AD-9726 |
| 1217-1235 | UCGUGCUGGUCACCGCUGCTsT | 503 | GCAGCGGUGACCAGCACGATsT | 504 | AD-9606 |
| 1217-1235 | ucGuGcuGGucAccGcuGcTsT | 505 | GcAGAGGUGACcAGcACGATsT | 506 | AD-9732 |
| 1223-1241 | UGGUCACCGCUGCCGGCAATsT | 507 | UUGCCGGCAGCGGUGACCATsT | 508 | AD-9633 |
| 1223-1241 | uGGucAccGcuGccGGcAATsT | 509 | UUGCCGGcAGCGGUGACcATsT | 510 | AD-9759 |
| 1224-1242 | GGUCACCGCUGCCGGCAACTsT | 511 | GUUGCCGGCAGCGGUGACCTsT | 512 | AD-9588 |
| 1224-1242 | GGucAccGcuGccGGcAAcTsT | 513 | GUUGCCGGcAGCGGUGACCTsT | 514 | AD-9714 |
| 1227-1245 | CACCGCUGCCGGCAACUUCTsT | 515 | GAAGUUGCCGGCAGCGGUGTsT | 516 | AD-9589 |
| 1227-1245 | cAccGcuGccGGcAAcuucTsT | 517 | GAAGUUGCCGGcAGCGGUGTsT | 518 | AD-9715 |
| 1229-1247 | CCGCUGCCGGCAACUUCCGTsT | 519 | CGGAAGUUGCCGGCAGCGGTsT | 520 | AD-9575 |
| 1229-1247 | ccGcuGccGGcAAcuuccGTsT | 521 | CGGAAGUUGCCGGcAGCGGTsT | 522 | AD-9701 |
| 1230-1248 | CGCUGCCGGCAACUUCCGGTsT | 523 | CCGGAAGUUGCCGGCAGCGTsT | 524 | AD-9563 |
| 1230-1248 | cGcuGccGGcAAcuuccGGTsT | 525 | CCGGAAGUUGCCGGcAGCGTsT | 526 | AD-9689 |
| 1231-1249 | GCUGCCGGCAACUUCCGGGTsT | 527 | CCCGGAAGUUGCCGGCAGCTsT | 528 | AD-9594 |
| 1231-1249 | GcuGccGGcAAcuuccGGGTsT | 529 | CCCGGAAGUUGCCGGcAGCTsT | 530 | AD-9720 |
| 1236-1254 | CGGCAACUUCCGGGACGAUTsT | 531 | AUCGUCCCGGAAGUUGCCGTsT | 532 | AD-9585 |
| 1236-1254 | cGGcAAcuuccGGGAcGAuTsT | 533 | AUCGUCCCGGAAGUUGCCGTsT | 534 | AD-9711 |
| 1237-1255 | GGCAACUUCCGGGACGAUGTsT | 535 | CAUCGUCCCGGAAGUUGCCTsT | 536 | AD-9614 |
| 1237-1255 | GGcAAcuuccGGGAcGAuGTsT | 537 | cAUCGUCCCGGAAGUUGCCTsT | 538 | AD-9740 |
| 1243-1261 | UUCCGGGACGAUGCCUGCCTsT | 539 | GGCAGGCAUCGUCCCGGAATsT | 540 | AD-9615 |
| 1243-1261 | uuccGGGAcGAuGccuGccTsT | 541 | GGcAGGcAUCGUCCCGGAATsT | 542 | AD-9741 |
| 1248-1266 | GGACGAUGCCUGCCUCUACTsT | 543 | GUAGAGGCAGGCAUCGUCCTsT | 544 | AD-9534 |
| 1248-1266 | GGACGAUGCCUGCCUCUACTsT | 545 | GUAGAGGCAGGCAUCGUCCTsT | 546 | AD-9534 |
| 1248-1266 | GGAcGAuGccuGccucuAcTsT | 547 | GuAGAGGcAGGcAUCGUCCTsT | 548 | AD-9660 |
| 1279-1297 | GCUCCCGAGGUCAUCACAGTT | 549 | CUGUGAUGACCUCGGGAGCTT | 550 | AD-15324 |
| 1280-1298 | CUCCCGAGGUCAUCACAGUTT | 551 | ACUGUGAUGACCUCGGGAGTT | 552 | AD-15232 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 1281-1299 | UCCCGAGGUCAUCACAGUUTT | 553 | AACUGUGAUGACCUCGGGATT | 554 | AD-15233 |
| 1314-1332 | CCAAGACCAGCCGGUGACCTT | 555 | GGUCACCGGCUGGUCUUGGTT | 556 | AD-15234 |
| 1315-1333 | CAAGACCAGCCGGUGACCCTT | 557 | GGGUCACCGGCUGGUCUUGTT | 558 | AD-15286 |
| 1348-1366 | ACCAACUUUGGCCGCUGUGTsT | 559 | CACAGCGGCCAAAGUUGGUTsT | 560 | AD-9590 |
| 1348-1366 | AccAAcuuuGGccGcuGuGTsT | 561 | cAcAGCGGCcAAAGUUGGUTsT | 562 | AD-9716 |
| 1350-1368 | CAACUUUGGCCGCUGUGUGTsT | 563 | CACACAGCGGCCAAAGUUGTsT | 564 | AD-9632 |
| 1350-1368 | cAAcuuuGGccGcuGuGuGTsT | 565 | cAcAcAGCGGCcAAAGUUGTsT | 566 | AD-9758 |
| 1360-1378 | CGCUGUGUGGACCUCUUUGTsT | 567 | CAAAGAGGUCCACACAGCGTsT | 568 | AD-9567 |
| 1360-1378 | cGcuGuGuGGAccucuuuGTsT | 569 | cAAAGAGGUCcAcAcAGCGTsT | 570 | AD-9693 |
| 1390-1408 | GACAUCAUUGGUGCCUCCATsT | 571 | UGGAGGCACCAAUGAUGUCTsT | 572 | AD-9586 |
| 1390-1408 | GAcAucAuuGGuGccuccATsT | 573 | UGGAGGcACcAAUGAUGUCTsT | 574 | AD-9712 |
| 1394-1412 | UCAUUGGUGCCUCCAGCGATsT | 575 | UCGCUGGAGGCACCAAUGATsT | 576 | AD-9564 |
| 1394-1412 | ucAuuGGuGccuccAGcGATsT | 577 | UCGCUGGAGGcAccAAUGATsT | 578 | AD-9690 |
| 1417-1435 | AGCACCUGCUUUGUGUCACTsT | 579 | GUGACACAAAGCAGGUGCUTsT | 580 | AD-9616 |
| 1417-1435 | AGcAccuGcuuuGuGucAcTsT | 581 | GUGAcAcAAAGcAGGUGCUTsT | 582 | AD-9742 |
| 1433-1451 | CACAGAGUGGGACAUCACATT | 583 | UGUGAUGUCCCACUCUGUGTT | 584 | AD-15398 |
| 1486-1504 | AUGCUGUCUGCCGAGCCGGTsT | 585 | CCGGCUCGGCAGACAGCAUTsT | 586 | AD-9617 |
| 1486-1504 | AuGcuGucuGccGAGccGGTsT | 587 | CCGGCUCGGCAGAcAGcAUTsT | 588 | AD-9743 |
| 1491-1509 | GUCUGCCGAGCCGGAGCUCTsT | 589 | GAGCUCCGGCUCGGCAGACTsT | 590 | AD-9635 |
| 1491-1509 | GucuGccGAGccGGAGcucTsT | 591 | GAGCUCCGGCUCGGcAGACTsT | 592 | AD-9761 |
| 1521-1539 | GUUGAGGCAGAGACUGAUCTsT | 593 | GAUCAGUCUCUGCCUCAACTsT | 594 | AD-9568 |
| 1521-1539 | GuuGAGGcAGAGAcuGAucTsT | 595 | GAUcAGUCUCUGCCUcAACTsT | 596 | AD-9694 |
| 1527-1545 | GCAGAGACUGAUCCACUUCTsT | 597 | GAAGUGGAUCAGUCUCUGCTsT | 598 | AD-9576 |
| 1527-1545 | GcAGAGAcuGAuccAcuucTsT | 599 | GAAGUGGAUcAGUCUCUGCTsT | 600 | AD-9702 |
| 1529-1547 | AGAGACUGAUCCACUUCUCTsT | 601 | GAGAAGUGGAUCAGUCUCUTsT | 602 | AD-9627 |
| 1529-1547 | AGAGAcuGAuccAcuucucTsT | 603 | GAGAAGUGGAUcAGUCUCUTsT | 604 | AD-9753 |
| 1543-1561 | UUCUCUGCCAAAGAUGUCATsT | 605 | UGACAUCUUUGGCAGAGAATsT | 606 | AD-9628 |
| 1543-1561 | uucucuGccAAAGAuGucATsT | 607 | UGAcAUCUUUGGcAGAGAATsT | 608 | AD-9754 |
| 1545-1563 | CUCUGCCAAAGAUGUCAUCTsT | 609 | GAUGACAUCUUUGGCAGAGTsT | 610 | AD-9631 |
| 1545-1563 | cucuGccAAAGAuGucAucTsT | 611 | GAUGAcAUCUUUGGcAGAGTsT | 612 | AD-9757 |
| 1580-1598 | CUGAGGACCAGCGGGUACUTsT | 613 | AGUACCCGCUGGUCCUCAGTsT | 614 | AD-9595 |
| 1580-1598 | cuGAGGAccAGcGGGuAcuTsT | 615 | AGuACCCGCUGGUCCUcAGTsT | 616 | AD-9721 |
| 1581-1599 | UGAGGACCAGCGGGUACUGTsT | 617 | CAGUACCCGCUGGUCCUCATsT | 618 | AD-9544 |
| 1581-1599 | uGAGGAccAGcGGGuAcuGTsT | 619 | cAGuACCCGCUGGUCCUcATsT | 620 | AD-9670 |
| 1666-1684 | ACUGUAUGGUCAGCACACUTT | 621 | AGUGUGCUGACCAUACAGUTT | 622 | AD-15235 |
| 1668-1686 | UGUAUGGUCAGCACACUCGTT | 623 | CGAGUGUGCUGACCAUACATT | 624 | AD-15236 |
| 1669-1687 | GUAUGGUCAGCACACUCGGTT | 625 | CCGAGUGUGCUGACCAUACTT | 626 | AD-15168 |
| 1697-1715 | GGAUGGCCACAGCCGUCGCTT | 627 | GCGACGGCUGUGGCCAUCCTT | 628 | AD-15174 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 1698-1716 | GAUGGCCACAGCCGUCGCCTT | 629 | GGCGACGGCUGUGGCCAUCTT | 630 | AD-15325 |
| 1806-1824 | CAAGCUGGUCUGCCGGGCCTT | 631 | GGCCCGGCAGACCAGCUUGTT | 632 | AD-15326 |
| 1815-1833 | CUGCCGGGCCCACAACGCUTsT | 633 | AGCGUUGUGGGCCCGGCAGTsT | 634 | AD-9570 |
| 1815-1833 | cuGccGGGcccAcAAcGcuTsT | 635 | AGCGUUGUGGGCCCGGcAGTsT | 636 | AD-9696 |
| 1816-1834 | UGCCGGGCCCACAACGCUUTsT | 637 | AAGCGUUGUGGGCCCGGCATsT | 638 | AD-9566 |
| 1816-1834 | uGccGGGcccAcAAcGcuuTsT | 639 | AAGCGUUGUGGGCCCGGcATsT | 640 | AD-9692 |
| 1818-1836 | CCGGGCCCACAACGCUUUUTsT | 641 | AAAAGCGUUGUGGGCCCGGTsT | 642 | AD-9532 |
| 1818-1836 | ccGGGcccAcAAcGcuuuuTsT | 643 | AAAAGCGUUGUGGGCCCGGTsT | 644 | AD-9658 |
| 1820-1838 | GGGCCCACAACGCUUUUGGTsT | 645 | CCAAAAGCGUUGUGGGCCCTsT | 646 | AD-9549 |
| 1820-1838 | GGGcccAcAAcGcuuuuGGTsT | 647 | CcAAAAGCGUUGUGGGCCCTsT | 648 | AD-9675 |
| 1840-1858 | GGUGAGGGUGUCUACGCCATsT | 649 | UGGCGUAGACACCCUCACCTsT | 650 | AD-9541 |
| 1840-1858 | GGuGAGGGuGucuAcGccATsT | 651 | UGGCGuAGAcACCCUcACCTsT | 652 | AD-9667 |
| 1843-1861 | GAGGGUGUCUACGCCAUUGTsT | 653 | CAAUGGCGUAGACACCCUCTsT | 654 | AD-9550 |
| 1843-1861 | GAGGGuGucuAcGccAuuGTsT | 655 | cAAUGGCGuAGAcACCCUCTsT | 656 | AD-9676 |
| 1861-1879 | GCCAGGUGCUGCCUGCUACTsT | 657 | GUAGCAGGCAGCACCUGGCTsT | 658 | AD-9571 |
| 1861-1879 | GccAGGuGcuGccuGcuAcTsT | 659 | GuAGcAGGcAGcACCUGGCTsT | 660 | AD-9697 |
| 1862-1880 | CCAGGUGCUGCCUGCUACCTsT | 661 | GGUAGCAGGCAGCACCUGGTsT | 662 | AD-9572 |
| 1862-1880 | ccAGGuGcuGccuGcuAccTsT | 663 | GGuAGcAGGcAGcACCUGGTsT | 664 | AD-9698 |
| 2008-2026 | ACCCACAAGCCGCCUGUGCTT | 665 | GCACAGGCGGCUUGUGGGUTT | 666 | AD-15327 |
| 2023-2041 | GUGCUGAGGCCACGAGGUCTsT | 667 | GACCUCGUGGCCUCAGCACTsT | 668 | AD-9639 |
| 2023-2041 | GuGcuGAGGccAcGAGGucTsT | 669 | GACCUCGUGGCCUCAGcACTsT | 670 | AD-9765 |
| 2024-2042 | UGCUGAGGCCACGAGGUCATsT | 671 | UGACCUCGUGGCCUCAGCATsT | 672 | AD-9518 |
| 2024-2042 | UGCUGAGGCCACGAGGUCATsT | 673 | UGACCUCGUGGCCUCAGCATsT | 674 | AD-9518 |
| 2024-2042 | uGcuGAGGccAcGAGGucATsT | 675 | UGACCUCGUGGCCUcAGcATsT | 676 | AD-9644 |
| 2024-2042 | UfgCfuGfaGfgCfcAfcGfaGfgUfcAfTsT | 677 | P*uGfaCfcUfcGfuGfgCfcUfcAfgCfaTsT | 678 | AD-14672 |
| 2024-2042 | UfGCfUfGAGGCfCfACfGAGGUfCfATsT | 679 | UfGACfCfUfCfGUfGGCfCfUfCfAGCfATsT | 680 | AD-14682 |
| 2024-2042 | UgCuGaGgCcAcGaGgUcATsT | 681 | P*uGfaCfcUfcGfuGfgCfcUfcAfgCfaTsT | 682 | AD-14692 |
| 2024-2042 | UgCuGaGgCcAcGaGgUcATsT | 683 | UfGACfCfUfCfGUfGGCfCfUfCfAGCfATsT | 684 | AD-14702 |
| 2024-2042 | UfgCfuGfaGfgCfcAfcGfaGfgUfcAfTsT | 685 | UGACCucGUggCCUCAgcaTsT | 686 | AD-14712 |
| 2024-2042 | UfGCfUfGAGGCfCfACfGAGGUfCfATsT | 687 | UGACCucGUggCCUCAgcaTsT | 688 | AD-14722 |
| 2024-2042 | UgCuGaGgCcAcGaGgUcATsT | 689 | UGACCucGUggCCUCAgcaTsT | 690 | AD-14732 |
| 2024-2042 | GfuGfgUfcAfgCfgGfcCfgGfgAfuGfTsT | 691 | P*cAfuCfcCfgGfcCfgCfuGfaCfcAfcTsT | 692 | AD-15078 |
| 2024-2042 | GUfGGUfCfAGCfGGCfCfGGGAUfGTsT | 693 | CfAUfCfCfCfGGCfCfGCfUfGACfCfACfTsT | 694 | AD-15088 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 2024-2042 | GuGgUcAgCgGcCgGgAuGTsT | 695 | P*cAfuCfcCfgGfcCfgCfuGfaCfcAfcTsT | 696 | AD-15098 |
| 2024-2042 | GuGgUcAgCgGcCgGgAuGTsT | 697 | CfAUfCfCfCfGGCfCfGCfUfGACfCfACfTsT | 698 | AD-15108 |
| 2024-2042 | GfuGfgUfcAfgCfgGfcCfgGfgAfuGfTsT | 699 | CAUCCcgGCcgCUGACcacTsT | 700 | AD-15118 |
| 2024-2042 | GUfGGUfCfAGCfGGCfCfGGGAUfGTsT | 701 | CAUCCcgGCcgCUGACcacTsT | 702 | AD-15128 |
| 2024-2042 | GuGgUcAgCgGcCgGgAuGTsT | 703 | CAUCCcgGCcgCUGACcacTsT | 704 | AD-15138 |
| 2030-2048 | GGCCACGAGGUCAGCCCAATT | 705 | UUGGGCUGACCUCGUGGCCTT | 706 | AD-15237 |
| 2035-2053 | CGAGGUCAGCCCAACCAGUTT | 707 | ACUGGUUGGGCUGACCUCGTT | 708 | AD-15287 |
| 2039-2057 | GUCAGCCCAACCAGUGCGUTT | 709 | ACGCACUGGUUGGGCUGACTT | 710 | AD-15238 |
| 2041-2059 | CAGCCCAACCAGUGCGUGGTT | 711 | CCACGCACUGGUUGGGCUGTT | 712 | AD-15328 |
| 2062-2080 | CACAGGGAGGCCAGCAUCCTT | 713 | GGAUGCUGGCCUCCCUGUGTT | 714 | AD-15399 |
| 2072-2090 | CCAGCAUCCACGCUUCCUGTsT | 715 | CAGGAAGCGUGGAUGCUGGTsT | 716 | AD-9582 |
| 2072-2090 | ccAGcAuccAcGcuuccuGTsT | 717 | cAGGAAGCGUGGAUGCUGGTsT | 718 | AD-9708 |
| 2118-2136 | AGUCAAGGAGCAUGGAAUCTsT | 719 | GAUUCCAUGCUCCUUGACUTsT | 720 | AD-9545 |
| 2118-2136 | AGucAAGGAGcAuGGAAucTsT | 721 | GAUUCcAUGCUCCUUGACUTsT | 722 | AD-9671 |
| 2118-2136 | AfgUfcAfaGfgAfgCfaUfgGfaAfuCfTsT | 723 | P*gAfuUfcCfaUfgCfuCfcUfuGfaCfuTsT | 724 | AD-14674 |
| 2118-2136 | AGUfCfAAGGAGCfAUfGGAAUfCfTsT | 725 | GAUfUfCfCfAUfGCfUfCfCfUfUfGACfUfTsT | 726 | AD-14684 |
| 2118-2136 | AgUcAaGgAgCaUgGaAuCTsT | 727 | P*gAfuUfcCfaUfgCfuCfcUfuGfaCfuTsT | 728 | AD-14694 |
| 2118-2136 | AgUcAaGgAgCaUgGaAuCTsT | 729 | GAUfUfCfCfAUfGCfUfCfCfUfUfGACfUfTsT | 730 | AD-14704 |
| 2118-2136 | AfgUfcAfaGfgAfgCfaUfgGfaAfuCfTsT | 731 | GAUUCcaUGcuCCUUGacuTsT | 732 | AD-14714 |
| 2118-2136 | AGUfCfAAGGAGCfAUfGGAAUfCfTsT | 733 | GAUUCcaUGcuCCUUGacuTsT | 734 | AD-14724 |
| 2118-2136 | AgUcAaGgAgCaUgGaAuCTsT | 735 | GAUUCcaUGcuCCUUGacuTsT | 736 | AD-14734 |
| 2118-2136 | GfcGfgCfaCfcCfuCfaUfaGfgCfcUfTsT | 737 | P*aGfgCfcUfaUfgAfgGfgUfgCfcGfcTsT | 738 | AD-15080 |
| 2118-2136 | GCfGGCfACfCfCfUfCfAUfAGGCfCfUfTsT | 739 | AGGCfCfUfUfAUfGAGGGUfGCfCfGCfTsT | 740 | AD-15090 |
| 2118-2136 | GcGgCaCcCuCaUaGgCcUTsT | 741 | P*aGfgCfcUfaUfgAfgGfgUfgCfcGfcTsT | 742 | AD-15100 |
| 2118-2136 | GcGgCaCcCuCaUaGgCuUTsT | 743 | AGGCfCfUfUfAUfGAGGGUfGCfCfGCfTsT | 744 | AD-15110 |
| 2118-2136 | GfcGfgCfaCfcCfuCfaUfaGfgCfcUfTsT | 745 | AGGCCuaUGagGGUGCcgcTsT | 746 | AD-15120 |
| 2118-2136 | GCfGGCfACfCfCfUfCfAUfAGGCfCfUfTsT | 747 | AGGCCuaUGagGGUGCcgcTsT | 748 | AD-15130 |
| 2118-2136 | GcGgCaCcCuCaUaGgCcUTsT | 749 | AGGCCuaUGagGGUGCcgcTsT | 750 | AD-15140 |
| 2122-2140 | AAGGAGCAUGGAAUCCCGGTsT | 751 | CCGGGAUUCCAUGCUCCUUTsT | 752 | AD-9522 |
| 2122-2140 | AAGGAGcAuGGAAucccGGTsT | 753 | CCGGGAUUCcAUGCUCCUUTsT | 754 | AD-9648 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 2123-2141 | AGGAGCAUGGAAUCCCGGCTsT | 755 | GCCGGGAUUCCAUGCUCCUTsT | 756 | AD-9552 |
| 2123-2141 | AGGAGcAuGGAAucccGGcTsT | 757 | GCCGGGAUUCcAUGCUCCUTsT | 758 | AD-9678 |
| 2125-2143 | GAGCAUGGAAUCCCGGCCCTsT | 759 | GGGCCGGGAUUCCAUGCUCTsT | 760 | AD-9618 |
| 2125-2143 | GAGcAuGGAAucccGGcccTsT | 761 | GGGCCGGGAUUCcAUGCUCTsT | 762 | AD-9744 |
| 2230-2248 | GCCUACGCCGUAGACAACATT | 763 | UGUUGUCUACGGCGUAGGCTT | 764 | AD-15239 |
| 2231-2249 | CCUACGCCGUAGACAACACTT | 765 | GUGUUGUCUACGGCGUAGGTT | 766 | AD-15212 |
| 2232-2250 | CUACGCCGUAGACAACACGTT | 767 | CGUGUUGUCUACGGCGUAGTT | 768 | AD-15240 |
| 2233-2251 | UACGCCGUAGACAACACGUTT | 769 | ACGUGUUGUCUACGGCGUATT | 770 | AD-15177 |
| 2235-2253 | CGCCGUAGACAACACGUGUTT | 771 | ACACGUGUUGUCUACGGCGTT | 772 | AD-15179 |
| 2236-2254 | GCCGUAGACAACACGUGUGTT | 773 | CACACGUGUUGUCUACGGCTT | 774 | AD-15180 |
| 2237-2255 | CCGUAGACAACACGUGUGUTT | 775 | ACACACGUGUUGUCUACGGTT | 776 | AD-15241 |
| 2238-2256 | CGUAGACAACACGUGUGUATT | 777 | UACACACGUGUUGUCUACGTT | 778 | AD-15268 |
| 2240-2258 | UAGACAACACGUGUGUAGUTT | 779 | ACUACACACGUGUUGUCUATT | 780 | AD-15242 |
| 2241-2259 | AGACAACACGUGUGUAGUCTT | 781 | GACUACACACGUGUUGUCUTT | 782 | AD-15216 |
| 2242-2260 | GACAACACGUGUGUAGUCATT | 783 | UGACUACACACGUGUUGUCTT | 784 | AD-15176 |
| 2243-2261 | ACAACACGUGUGUAGUCAGTT | 785 | CUGACUACACACGUGUUGUTT | 786 | AD-15181 |
| 2244-2262 | CAACACGUGUGUAGUCAGGTT | 787 | CCUGACUACACACGUGUUGTT | 788 | AD-15243 |
| 2247-2265 | CACGUGUGUAGUCAGGAGCTT | 789 | GCUCCUGACUACACACGUGTT | 790 | AD-15182 |
| 2248-2266 | ACGUGUGUAGUCAGGAGCCTT | 791 | GGCUCCUGACUACACACGUTT | 792 | AD-15244 |
| 2249-2267 | CGUGUGUAGUCAGGAGCCGTT | 793 | CGGCUCCUGACUACACACGTT | 794 | AD-15387 |
| 2251-2269 | UGUGUAGUCAGGAGCCGGGTT | 795 | CCCGGCUCCUGACUACACATT | 796 | AD-15245 |
| 2257-2275 | GUCAGGAGCCGGGACGUCATsT | 797 | UGACGUCCCGGCUCCUGACTsT | 798 | AD-9555 |
| 2257-2275 | GucAGGAGccGGGAcGucATsT | 799 | UGACGUCCCGGCUCCUGACTsT | 800 | AD-9681 |
| 2258-2276 | UCAGGAGCCGGGACGUCAGTsT | 801 | CUGACGUCCCGGCUCCUGATsT | 802 | AD-9619 |
| 2258-2276 | ucAGGAGccGGGAcGucAGTsT | 803 | CUGACGUCCCGGCUCCUGATsT | 804 | AD-9745 |
| 2259-2277 | CAGGAGCCGGGACGUCAGCTsT | 805 | GCUGACGUCCCGGCUCCUGTsT | 806 | AD-9620 |
| 2259-2277 | cAGGAGccGGGAcGucAGcTsT | 807 | GCUGACGUCCCGGCUCCUGTsT | 808 | AD-9746 |
| 2263-2281 | AGCCGGGACGUCAGCACUATT | 809 | UAGUGCUGACGUCCCGGCUTT | 810 | AD-15288 |
| 2265-2283 | CCGGGACGUCAGCACUACATT | 811 | UGUAGUGCUGACGUCCCGGTT | 812 | AD-15246 |
| 2303-2321 | CCGUGACAGCCGUUGCCAUTT | 813 | AUGGCAACGGCUGUCACGGTT | 814 | AD-15289 |
| 2317-2335 | GCCAUCUGCUGCCGGAGCCTsT | 815 | GGCUCCGGCAGCAGAUGGCTsT | 816 | AD-9324 |
| 2375-2393 | CCCAUCCCAGGAUGGGUGUTT | 817 | ACACCCAUCCUGGGAUGGGTT | 818 | AD-15329 |
| 2377-2395 | CAUCCCAGGAUGGGUGUCUTT | 819 | AGACACCCAUCCUGGGAUGTT | 820 | AD-15330 |
| 2420-2438 | AGCUUUAAAAUGGUUCCGATT | 821 | UCGGAACCAUUUUAAAGCUTT | 822 | AD-15169 |
| 2421-2439 | GCUUUAAAAUGGUUCCGACTT | 823 | GUCGGAACCAUUUUAAAGCTT | 824 | AD-15201 |
| 2422-2440 | CUUUAAAAUGGUUCCGACUTT | 825 | AGUCGGAACCAUUUUAAAGTT | 826 | AD-15331 |
| 2423-2441 | UUUAAAAUGGUUCCGACUUTT | 827 | AAGUCGGAACCAUUUUAAATT | 828 | AD-15190 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 2424-2442 | UUAAAAUGGUUCCGACUUGUU | 829 | CAAGUCGGAACCAUUUUAAUU | 830 | AD-15247 |
| 2425-2443 | UAAAAUGGUUCCGACUUGUUTT | 831 | ACAAGUCGGAACCAUUUUAUU | 832 | AD-15248 |
| 2426-2444 | AAAAUGGUUCCGACUUGUCTT | 833 | GACAAGUCGGAACCAUUUUTT | 834 | AD-15175 |
| 2427-2445 | AAAUGGUUCCGACUUGUCCTT | 835 | GGACAAGUCGGAACCAUUUTT | 836 | AD-15249 |
| 2428-2446 | AAUGGUUCCGACUUGUCCCTT | 837 | GGGACAAGUCGGAACCAUUTT | 838 | AD-15250 |
| 2431-2449 | GGUUCCGACUUGUCCCUCUTT | 839 | AGAGGGACAAGUCGGAACCTT | 840 | AD-15400 |
| 2457-2475 | CUCCAUGGCCUGGCACGAGTT | 841 | CUCGUGCCAGGCCAUGGAGTT | 842 | AD-15332 |
| 2459-2477 | CCAUGGCCUGGCACGAGGGTT | 843 | CCCUCGUGCCAGGCCAUGGTT | 844 | AD-15388 |
| 2545-2563 | GAACUCACUCACUCUGGGUTT | 845 | ACCCAGAGUGAGUGAGUUCTT | 846 | AD-15333 |
| 2549-2567 | UCACUCACUCUGGGUGCCUTT | 847 | AGGCACCCAGAGIGAGIGATT | 848 | AD-15334 |
| 2616-2634 | UUUCACCAUUCAAACAGGUTT | 849 | ACCUGUUUGAAUGGUGAAATT | 850 | AD-15335 |
| 2622-2640 | CAUUCAAACAGGUCGAGCUTT | 851 | AGCUCGACCUGUUUGAAUGTT | 852 | AD-15183 |
| 2623-2641 | AUUCAAACAGGUCGAGCUGTT | 853 | CAGCUCGACCUGUUUGAAUTT | 854 | AD-15202 |
| 2624-2642 | UUCAAACAGGUCGAGCUGUTT | 855 | ACAGCUCGACCUGUUUGAATT | 856 | AD-15203 |
| 2625-2643 | UCAAACAGGUCGAGCUGUGTT | 857 | CACAGCUCGACCUGUUUGATT | 858 | AD-15272 |
| 2626-2644 | CAAACAGGUCGAGCUGUGCTT | 859 | GCACAGCUCGACCUGUUUGTT | 860 | AD-15217 |
| 2627-2645 | AAACAGGUCGAGCUGUGCUTT | 861 | AGCACAGCUCGACCUGUUUTT | 862 | AD-15290 |
| 2628-2646 | AACAGGUCGAGCUGUGCUCTT | 863 | GAGCACAGCUCGACCUGUUTT | 864 | AD-15218 |
| 2630-2648 | CAGGUCGAGCUGUGCUCGGTT | 865 | CCGAGCACAGCUCGACCUGTT | 866 | AD-15389 |
| 2631-2649 | AGGUCGAGCUGUGCUCGGGTT | 867 | CCCGAGCACAGCUCGACCUTT | 868 | AD-15336 |
| 2633-2651 | GUCGAGCUGUGCUCGGGUGTT | 869 | CACCCGAGCACAGCUCGACTT | 870 | AD-15337 |
| 2634-2652 | UCGAGCUGUGCUCGGGUGCTT | 871 | GCACCCGAGCACAGCUCGATT | 872 | AD-15191 |
| 2657-2675 | AGCUGCUCCCAAUGUGCCGTT | 873 | CGGCACAUUGGGAGCAGCUTT | 874 | AD-15390 |
| 2658-2676 | GCUGCUCCCAAUGUGCCGATT | 875 | UCGGCACAUUGGGAGCAGCTT | 876 | AD-15338 |
| 2660-2678 | UGCUCCCAAUGUGCCGAUGTT | 877 | CAUCGGCACAUUGGGAGCATT | 878 | AD-15204 |
| 2663-2681 | UCCCAAUGUGCCGAUGUCCTT | 879 | GGACAUCGGCACAUUGGGATT | 880 | AD-15251 |
| 2665-2683 | CCAAUGUGCCGAUGUCCGUTT | 881 | ACGGACAUCGGCACAUUGGTT | 882 | AD-15205 |
| 2666-2684 | CAAUGUGCCGAUGUCCGUGTT | 883 | CACGGACAUCGGCACAUUGTT | 884 | AD-15171 |
| 2667-2685 | AAUGUGCCGAUGUCCGUGGTT | 885 | CCACGGACAUCGGCACAUUTT | 886 | AD-15252 |
| 2673-2691 | CCGAUGUCCGUGGGCAGAATT | 887 | UUCUGCCCACGGACAUCGGTT | 888 | AD-15339 |
| 2675-2693 | GAUGUCCGUGGGCAGAAUGTT | 889 | CAUUCUGCCCACGGACAUCTT | 890 | AD-15253 |
| 2678-2696 | GUCCGUGGGCAGAAUGACUTT | 891 | AGUCAUUCUGCCCACGGACTT | 892 | AD-15340 |
| 2679-2697 | UCCGUGGGCAGAAUGACUUTT | 893 | AAGUCAUUCUGCCCACGGATT | 894 | AD-15291 |
| 2683-2701 | UGGGCAGAAUGACUUUUAUTT | 895 | AUAAAAGUCAUUCUGCCCATT | 896 | AD-15341 |
| 2694-2712 | ACUUUUAUUGAGCUCUUGUTT | 897 | ACAAGAGCUCAAUAAAAGUTT | 898 | AD-15401 |
| 2700-2718 | AUUGAGCUCUUGUUCCGUGTT | 899 | CACGGAACAAGAGCUCAAUTT | 900 | AD-15342 |
| 2704-2722 | AGCUCUUGUUCCGUGCCAGTT | 901 | CUGGCACGGAACAAGAGCUTT | 902 | AD-15343 |
| 2705-2723 | GCUCUUGUUCCGUGCCAGGTT | 903 | CCUGGCACGGAACAAGAGCTT | 904 | AD-15292 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 2710-2728 | UGUUCCGUGCCAGGCAUUCTT | 905 | GAAUGCCUGGCACGGAACATT | 906 | AD-15344 |
| 2711-2729 | GUUCCGUGCCAGGCAUUCATT | 907 | UGAAUGCCUGGCACGGAACTT | 908 | AD-15254 |
| 2712-2730 | UUCCGUGCCAGGCAUUCAATT | 909 | UUGAAUGCCUGGCACGGAATT | 910 | AD-15345 |
| 2715-2733 | CGUGCCAGGCAUUCAAUCCTT | 911 | GGAUUGAAUGCCUGGCACGTT | 912 | AD-15206 |
| 2716-2734 | GUGCCAGGCAUUCAAUCCUTT | 913 | AGGAUUGAAUGCCUGGCACTT | 914 | AD-15346 |
| 2728-2746 | CAAUCCUCAGGUCUCCACCTT | 915 | GGUGGAGACCUGAGGAUUGTT | 916 | AD-15347 |
| 2743-2761 | CACCAAGGAGGCAGGAUUCTsT | 917 | GAAUCCUGCCUCCUUGGUGTsT | 918 | AD-9577 |
| 2743-2761 | cAccAAGGAGGcAGGAuucTsT | 919 | GAAUCCUGCCUCCUUGGUGTsT | 920 | AD-9703 |
| 2743-2761 | CfaCfcAfaGfgAfgGfcAfgGfaUfuCfTsT | 921 | P*gAfaUfcCfuGfcCfuCfcUfuGfgUfgTsT | 922 | AD-14678 |
| 2743-2761 | CfACfCfAAGGAGGCfAGGAUfUfCfTsT | 923 | GAAUfCfCfUfGCfCfUfCfCfUfUfGGUfGTsT | 924 | AD-14688 |
| 2743-2761 | CaCcAaGgAgGcAgGaUuCTsT | 925 | P*gAfaUfcCfuGfcCfuCfcUfuGfgUfgTsT | 926 | AD-14698 |
| 2743-2761 | CaCcAaGgAgGcAgGaUuCTsT | 927 | GAAUfCfCfUfGCfCfUfCfCfUfUfGGUfGTsT | 928 | AD-14708 |
| 2743-2761 | CfaCfcAfaGfgAfgGfcAfgGfaUfuCfTsT | 929 | GAAUCcuGCcuCCUUGgugTsT | 930 | AD-14718 |
| 2743-2761 | CfACfCfAAGGAGGCfAGGAUfUfCfTsT | 931 | GAAUCcuGCcuCCUUGgugTsT | 932 | AD-14728 |
| 2743-2761 | CaCuAaGgAgGcAgGaUuCTsT | 933 | GAAUCcuGCcuCCUUGgugTsT | 934 | AD-14738 |
| 2743-2761 | GfgCfcUfgGfaGfuUfuAfuUfcGfgAfTsT | 935 | P*uCfcGfaAfuAfaAfcUfcCfaGfgCfcTsT | 936 | AD-15084 |
| 2743-2761 | GGCfCfUfGGAGUfUfUfAUfUfCfGGATsT | 937 | UfCfCfGAAUfAAACfUfCfCfAGGCfCfTsT | 938 | AD-15094 |
| 2743-2761 | GgCcUgGaGuUuAuUcGgATsT | 939 | P*uCfcGfaAfuAfaAfcUfcCfaGfgCfcTsT | 940 | AD-15104 |
| 2743-2761 | GgCcUgGaGuUuAuUcGgATsT | 941 | UfCfCfGAAUfAAACfUfCfCfAGGCfCfTsT | 942 | AD-15114 |
| 2743-2761 | GfgCfcUfgGfaGfuUfuAfuUfcGfgAfTsT | 943 | UCCGAauAAacUCCAGgccTsT | 944 | AD-15124 |
| 2743-2761 | GGCfCfUfGGAGUfUfUfAUfUfCfGGATsT | 945 | UCCGAauAAacUCCAGgccTsT | 946 | AD-15134 |
| 2743-2761 | GgCcUgGaGuUuAuUcGgATsT | 947 | UCCGAauAAacUCCAGgccTsT | 948 | AD-15144 |
| 2753-2771 | GCAGGAUUCUUCCCAUGGATT | 949 | UCCAUGGGAAGAAUCCUGCTT | 950 | AD-15391 |
| 2794-2812 | UGCAGGGACAAACAUCGUUTT | 951 | AACGAUGUUUGUCCCUGCATT | 952 | AD-15348 |
| 2795-2813 | GCAGGGACAAACAUCGUUGTT | 953 | CAACGAUGUUUGUCCCUGCTT | 954 | AD-15349 |
| 2797-2815 | AGGGACAAACAUCGUUGGTT | 955 | CCCAACGAUGUUUGUCCCUTT | 956 | AD-15170 |
| 2841-2859 | CCCUCAUCUCCAGCUAACUTT | 957 | AGUUAGCUGGAGAUGAGGGTT | 958 | AD-15350 |
| 2845-2863 | CAUCUCCAGCUAACUGUGGTT | 959 | CCACAGUUAGCUGGAGAUGTT | 960 | AD-15402 |
| 2878-2896 | GCUCCCUGAUUAAUGGAGGTT | 961 | CCUCCAUUAAUCAGGGAGCTT | 962 | AD-15293 |
| 2881-2899 | CCCUGAUUAAUGGAGGCUUTT | 963 | AAGCCUCCAUUAAUCAGGGTT | 964 | AD-15351 |
| 2882-2900 | CCUGAUUAAUGGAGGCUUATT | 965 | UAAGCCUCCAUUAAUCAGGTT | 966 | AD-15403 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 2884-2902 | UGAUUAAUGGAGGCUUAGCTT | 967 | GCUAAGCCUCCAUUAAUCATT | 968 | AD-15404 |
| 2885-2903 | GAUUAAUGGAGGCUUAGCUTT | 969 | AGCUAAGCCUCCAUUAAUCTT | 970 | AD-15207 |
| 2886-2904 | AUUAAUGGAGGCUUAGCUUTT | 971 | AAGCUAAGCCUCCAUUAAUTT | 972 | AD-15352 |
| 2887-2905 | UUAAUGGAGGCUUAGCUUUTT | 973 | AAAGCUAAGCCUCCAUUAATT | 974 | AD-15255 |
| 2903-2921 | UUUCUGGAUGGCAUCUAGCTsT | 975 | GCUAGAUGCCAUCCAGAAATsT | 976 | AD-9603 |
| 2903-2921 | uuucuGGAuGGcAucuAGcTsT | 977 | GCuAGAUGCcAUCcAGAAATsT | 978 | AD-9729 |
| 2904-2922 | UUCUGGAUGGCAUCUAGCCTsT | 979 | GGCUAGAUGCCAUCCAGAAATsT | 980 | AD-9599 |
| 2904-2922 | uucuGGAuGGcAucuAGccTsT | 981 | GGCuAGAUGCcAUCcAGAAATsT | 982 | AD-9725 |
| 2905-2923 | UCUGGAUGGCAUCUAGCCATsT | 983 | UGGCUAGAUGCCAUCCAGATsT | 984 | AD-9621 |
| 2905-2923 | ucuGGAuGGcAucuAGccATsT | 985 | UGGCuAGAUGCcAUCcAGATsT | 986 | AD-9747 |
| 2925-2943 | AGGCUGGAGACAGGUGCGCTT | 987 | GCGCACCUGUCUCCAGCCUTT | 988 | AD-15405 |
| 2926-2944 | GGCUGGAGACAGGUGCGCCTT | 989 | GGCGCACCUGUCUCCAGCCTT | 990 | AD-15353 |
| 2927-2945 | GCUGGAGACAGGUGCGCCCTT | 991 | GGGCGCACCUGUCUCCAGCTT | 992 | AD-15354 |
| 2972-2990 | UUCCUGAGCCACCUUUACUTT | 993 | AGUAAAGGUGGCUCAGGAATT | 994 | AD-15406 |
| 2973-2991 | UCCUGAGCCACCUCUACUCTT | 995 | GAGUAAAGGUGGCUCAGGATT | 996 | AD-15407 |
| 2974-2992 | CCUGAGCCACCUUCACUCUTT | 997 | AGAGUAAAGGUGGCUCAGGTT | 998 | AD-15355 |
| 2976-2994 | UGAGCCACCUUUACUCUGCTT | 999 | GCAGAGUAAAGGUGGCUCATT | 1000 | AD-15356 |
| 2978-2996 | AGCCACCUUUACUCUGCUCTT | 1001 | GAGCAGAGUAAAGGUGGCUTT | 1002 | AD-15357 |
| 2981-2999 | CACCUUUACUCUGCUCUAUTT | 1003 | AUAGAGCAGAGUAAAGGUGTT | 1004 | AD-15269 |
| 2987-3005 | UACUCUGCUCUAUGCCAGGTsT | 1005 | CCUGGCAUAGAGCAGAGUATsT | 1006 | AD-9565 |
| 2987-3005 | uAcucuGcucuAuGccAGGTsT | 1007 | CCUGGcAuAGAGcAGAGuATsT | 1008 | AD-9691 |
| 2998-3016 | AUGCCAGGCUGUGCUAGCATT | 1009 | UGCUAGCACAGCCUGGCAUTT | 1010 | AD-15358 |
| 3003-3021 | AGGCUGUGCUAGCAACACCTT | 1011 | GGUGUUGCUAGCACAGCCUTT | 1012 | AD-15359 |
| 3006-3024 | CUGUGCUAGCAACACCCAATT | 1013 | UUGGGUGUUGCUAGCACAGTT | 1014 | AD-15360 |
| 3010-3028 | GCUAGCAACACCCAAAGGUTT | 1015 | ACCUUUGGGUGUUGCUAGCTT | 1016 | AD-15219 |
| 3038-3056 | GGAGCCAUCACCUAGGACUTT | 1017 | AGUCCUAGGUGAUGGCUCCTT | 1018 | AD-15361 |
| 3046-3064 | CACCUAGGACUGACUCGGCTT | 1019 | GCCGAGUCAGUCCUAGGUGTT | 1020 | AD-15273 |
| 3051-3069 | AGGACUGACUCGGCAGUGUTT | 1021 | ACACUGCCGAGUCAGUCCUTT | 1022 | AD-15362 |
| 3052-3070 | GGACUGACUCGGCAGUGUGTT | 1023 | CACACUGCCGAGUCAGUCCTT | 1024 | AD-15192 |
| 3074-3092 | UGGUGCAUGCACUGUCUCATT | 1025 | UGAGACAGUGCAUGCACCATT | 1026 | AD-15256 |
| 3080-3098 | AUGCACUGUCUCAGCCAACTT | 1027 | GUUGGCUGAGACAGUGCAUTT | 1028 | AD-15363 |
| 3085-3103 | CUGUCUCAGCCAACCCGCUTT | 1029 | AGCGGGUUGGCUGAGACAGTT | 1030 | AD-15364 |
| 3089-3107 | CUCAGCCAACCCGCUCCACTsT | 1031 | GUGGAGCGGGUUGGCUGAGTsT | 1032 | AD-9604 |
| 3089-3107 | cucAGccAAcccGcuccAcTsT | 1033 | GUGGAGCGGGUUGGCUGAGTsT | 1034 | AD-9730 |
| 3093-3111 | GCCAACCCGCUCCACUACCTsT | 1035 | GGUAGUGGAGCGGGUUGGCTsT | 1036 | AD-9527 |
| 3093-3111 | GccAAcccGcuccAcuAccTsT | 1037 | GGuAGUGGAGCGGGUUGGCTsT | 1038 | AD-9653 |
| 3096-3114 | AACCCGCUCCACUACCCGGTT | 1039 | CCGGGUAGUGGAGCGGGUUTT | 1040 | AD-15365 |
| 3099-3117 | CCGCUCCACUACCCGGCAGTT | 1041 | CUGCCGGGUAGUGGAGCGGTT | 1042 | AD-15294 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 3107-3125 | CUACCCGGCAGGGUACACATT | 1043 | UGUGUACCCUGCCGGGUAGTT | 1044 | AD-15173 |
| 3108-3126 | UACCCGGCAGGGUACACAUTT | 1045 | AUGUGUACCCUGCCGGGUATT | 1046 | AD-15366 |
| 3109-3127 | ACCCGGCAGGGUACACAUUTT | 1047 | AAUGUGUACCCUGCCGGGUTT | 1048 | AD-15367 |
| 3110-3128 | CCCGGCAGGGUACACAUUCTT | 1049 | GAAUGUGUACCCUGCCGGGTT | 1050 | AD-15257 |
| 3112-3130 | CGGCAGGGUACACAUUCGCTT | 1051 | GCGAAUGUGUACCCUGCCGTT | 1052 | AD-15184 |
| 3114-3132 | GCAGGGUACACAUUCGCACTT | 1053 | GUGCGAAUGUGUACCCUGCTT | 1054 | AD-15185 |
| 3115-3133 | CAGGGUACACAUUCGCACCTT | 1055 | GGUGCGAAUGUGUACCCUGTT | 1056 | AD-15258 |
| 3116-3134 | AGGGUACACAUUCGCACCCTT | 1057 | GGGUGCGAAUGUGUACCCUTT | 1058 | AD-15186 |
| 3196-3214 | GGAACUGAGCCAGAAACGCTT | 1059 | GCGUUUCUGGCUCAGUUCCTT | 1060 | AD-15274 |
| 3197-3215 | GAACUGAGCCAGAAACGCATT | 1061 | UGCGUUUCUGGCUCAGUUCTT | 1062 | AD-15368 |
| 3198-3216 | AACUGAGCCAGAAACGCAGTT | 1063 | CUGCGUUUCUGGCUCAGUUTT | 1064 | AD-15369 |
| 3201-3219 | UGAGCCAGAAACGCAGAUUTT | 1065 | AAUCUGCGUUUCUGGCUCATT | 1066 | AD-15370 |
| 3207-3225 | AGAAACGCAGAUUGGGCUCTT | 1067 | CAGCCCAAUCUGCGUUUCUTT | 1068 | AD-15259 |
| 3210-3228 | AACGCAGAUUGGGCUGGCUTT | 1069 | AGCCAGCCCAAUCUGCGUUTT | 1070 | AD-15408 |
| 3233-3251 | AGCCAAGCCUCUUCUUACUsT | 1071 | AGUAAGAAGAGGCUUGGCUsT | 1072 | AD-9597 |
| 3233-3251 | AGccAAGccucuucuuAcuTsT | 1073 | AGuAAGAAGAGGCUUGGCUsT | 1074 | AD-9723 |
| 3233-3251 | AfgCfcAfaGfcCfuCfuUfcUfuAfcUfTsT | 1075 | P*aGfuAfaGfaAfgAfgGfcUfuGfgCfuTsT | 1076 | AD-14680 |
| 3233-3251 | AGCfCfAAGCfCfUfCfUfUfCfUfUfACfUfTsT | 1077 | AGUfAAGAAGAGGCfUfUfGGCfUfTsT | 1078 | AD-14690 |
| 3233-3251 | AgCcAaGcCuCuUcUuAcUTsT | 1079 | P*aGfuAfaGfaAfgAfgGfcUfuGfgCfuTsT | 1080 | AD-14700 |
| 3233-3251 | AgCcAaGcCuCuUcUuAcUTsT | 1081 | AGUfAAGAAGAGGCfUfUfGGCfUfTsT | 1082 | AD-14710 |
| 3233-3251 | AfgCfcAfaGfcCfuCfuUfcUfuAfcUfTsT | 1083 | AGUAAgaAGagGCUUGgcuTsT | 1084 | AD-14720 |
| 3233-3251 | AGCfCfAAGCfCfUfCfUfUfCfUfUfACfUfTsT | 1085 | AGUAAgaAGagGCUUCgcuTsT | 1086 | AD-14730 |
| 3233-3251 | AgCcAaGcCuCuUcUuAcUTsT | 1087 | AGUAAgaAGagGCUUGgcuTsT | 1088 | AD-14740 |
| 3233-3251 | UfgGfuUfcCfcUfgAfgGfaCfcAfgCfTsT | 1089 | P*gCfuGfgUfcCfuCfaGfgGfaAfcCfaTsT | 1090 | AD-15086 |
| 3233-3251 | UfGGUfUfCfCfCfUfGAGGACfCfAGCfTsT | 1091 | GCfUfGGUfCfCfUfCfAGGGAACfCfATsT | 1092 | AD-15096 |
| 3233-3251 | UgGuUcCcUgAgGaCcAgCTsT | 1093 | P*gCfuGfgUfcCfuCfaGfgGfaAfcCfaTsT | 1094 | AD-15106 |
| 3233-3251 | UgGuUcCcUgAgGaCcAgCTsT | 1095 | GCfUfGGUfCfCfUfCfAGGGAACfCfATsT | 1096 | AD-15116 |
| 3233-3251 | UfgGfuUfcCfcUfgAfgGfaCfcAfgCfTsT | 1097 | GCUGGucCUcaGGGAAccaTsT | 1098 | AD-15126 |
| 3233-3251 | UfGGUfUfCfCfCfUfGAGGACfCfAGCfTsT | 1099 | GCUGGucCUcaGGGAAccaTsT | 1100 | AD-15136 |
| 3233-3251 | UgGuUcCcUgAgGaCcAgCTsT | 1101 | GCUGGucCUcaGGGAAccaTsT | 1102 | AD-15146 |
| 3242-3260 | UCUUCUUACUUCACCCGGCTT | 1103 | GCCGGGUGAAGUAAGAAGATT | 1104 | AD-15260 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 3243-3261 | CUUCUUACUUCACCCGGCUTT | 1105 | AGCCGGGUGAAGUAAGAAGTT | 1106 | AD-15371 |
| 3244-3262 | UUCUUACUUCACCCGGCUGTT | 1107 | CAGCCGGGUGAAGUAAGAATT | 1108 | AD-15372 |
| 3262-3280 | GGGCUCCUCAUUUUUACGGTT | 1109 | CCGUAAAAAUGAGGAGCCCTT | 1110 | AD-15172 |
| 3263-3281 | GGCUCCUCAUUUUUACGGGTT | 1111 | CCCGUAAAAAUGAGGAGCCTT | 1112 | AD-15295 |
| 3264-3281 | GCUCCUCAUUUUUACGGGUTT | 1113 | ACCCGUAAAAAUGAGGAGCTT | 1114 | AD-15373 |
| 3265-3283 | CUCCUCAUUUUUACGGGUATT | 1115 | UACCCGUAAAAAUGAGGAGTT | 1116 | AD-15163 |
| 3266-3284 | UCCUCAUUUUUACGGGUAATT | 1117 | UUACCCGUAAAAAUGAGGATT | 1118 | AD-15165 |
| 3267-3285 | CCUCAUUUUUACGGGUAACTT | 1119 | GUUACCCGUAAAAAUGAGGTT | 1120 | AD-15374 |
| 3268-3286 | CUCAUUUUUACGGGUAACATT | 1121 | UGUUACCCGUAAAAAUGAGTT | 1122 | AD-15296 |
| 3270-3288 | CAUUUUUACGGGUAACAGUTT | 1123 | ACUGUUACCCGUAAAAAUGTT | 1124 | AD-15261 |
| 3271-3289 | AUUUUUACGGGUAACAGUGTT | 1125 | CACUGUUACCCGUAAAAAUTT | 1126 | AD-15375 |
| 3274-3292 | UUUACGGGUAACAGUGAGGTT | 1127 | CCUCACUGUUACCCGUAAATT | 1128 | AD-15262 |
| 3308-3326 | CAGACCAGGAAGCUCGGUGTT | 1129 | CACCGAGCUUCCUGGUCUGTT | 1130 | AD-15376 |
| 3310-3328 | GACCAGGAAGCUCGGUGAGTT | 1131 | CUCACCGAGCUUCCUGGUCTT | 1132 | AD-15377 |
| 3312-3330 | CCAGGAAGCUCGGUGAGUGTT | 1133 | CACUCACCGAGCUUCCUGGTT | 1134 | AD-15409 |
| 3315-3333 | GGAAGCUCGGUGAGUGAUGTT | 1135 | CAUCACUCACCGAGCUUCCTT | 1136 | AD-15378 |
| 3324-3342 | GUGAGUGAUGGCAGAACGATT | 1137 | UCGUUCUGCCAUCACUCACTT | 1138 | AD-15410 |
| 3326-3344 | GAGUGAUGGCAGAACGAUGTT | 1139 | CAUCGUUCUGCCAUCACUCTT | 1140 | AD-15379 |
| 3330-3348 | GAUGGCAGAACGAUGCCUGTT | 1141 | CAGGCAUCGUUCUGCCAUCTT | 1142 | AD-15187 |
| 3336-3354 | AGAACGAUGCCUGCAGGCATT | 1143 | UGCCUGCAGGCAUCGUUCUTT | 1144 | AD-15263 |
| 3339-3357 | ACGAUGCCUGCAGGCAUGGTT | 1145 | CCAUGCCUGCAGGCAUCGUTT | 1146 | AD-15264 |
| 3348-3366 | GCAGGCAUGGAACUUUUUCTT | 1147 | GAAAAAGUUCCAUGCCUGCTT | 1148 | AD-15297 |
| 3356-3374 | GGAACUUUUUCCGUUAUCATT | 1149 | UGAUAACGGAAAAAGUUCCTT | 1150 | AD-15208 |
| 3357-3375 | GAACUUUUUCCGUCAUCACTT | 1151 | GUGAUAACGGAAAAAGUUCTT | 1152 | AD-15209 |
| 3358-3376 | AACUUUUUCCGUUAUCACCTT | 1153 | GGUGAUAACGGAAAAAGUUTT | 1154 | AD-15193 |
| 3370-3388 | UAUCACCCAGGCCUGAUUCTT | 1155 | GAAUCAGGCCUGGGUGAUATT | 1156 | AD-15380 |
| 3378-3396 | AGGCCUGAUUCACUGGCCUTT | 1157 | AGGCCAGUGAAUCAGGCCUTT | 1158 | AD-15298 |
| 3383-3401 | UGAUUCACUGGCCUGGCGGTT | 1159 | CCGCCAGGCCAGUGAAUCATT | 1160 | AD-15299 |
| 3385-3403 | AUUCACUGGCCUGGCGGAGTT | 1161 | CUCCGCCAGGCCAGUGAAUTT | 1162 | AD-15265 |
| 3406-3424 | GCUUCUAAGGCAUGGUCGGTT | 1163 | CCGACCAUGCCUUAGAAGCTT | 1164 | AD-15381 |
| 3407-3425 | CUUCUAAGGCAUGGUCGGGTT | 1165 | CCCGACCAUGCCUUAGAAGTT | 1166 | AD-15210 |
| 3429-3447 | GAGGGCCAACAACUGUCCCTT | 1167 | GGGACAGUUGUUGGCCCUCTT | 1168 | AD-15270 |
| 3440-3458 | ACUGUCCCUCCUUGAGCACTsT | 1169 | GUGCUCAAGGAGGGACAGUTsT | 1170 | AD-9591 |
| 3440-3458 | AcuGucccuccuuGAGcAcTsT | 1171 | GUGCUcAAGGAGGGAcAGUTsT | 1172 | AD-9717 |
| 3441-3459 | CUGUCCCUCCUUGAGCACCTsT | 1173 | GGUGCUCAAGGAGGGACAGTsT | 1174 | AD-9622 |
| 3441-3459 | cuGucccuccuuGAGcAccTsT | 1175 | GGUGCUcAAGGAGGGAcAGTsT | 1176 | AD-9748 |
| 3480-3498 | ACAUUUAUCUUUUGGGUCUTsT | 1177 | AGACCCAAAAGAUAAAUGUTsT | 1178 | AD-9587 |
| 3480-3498 | AcAuuuAucuuuuGGGucuTsT | 1179 | AGACCcAAAAGAuAAAUGUTsT | 1180 | AD-9713 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 3480-3498 | AfcAfuUfuAfuCfuUfuUfgGfgU fcUfTsT | 1181 | P*aGfaCfcCfaAfaAfgAfuAfa AfuGfuTsT | 1182 | AD-14679 |
| 3480-3498 | ACfAUfUfUfAUfCfUfUfUfUfGG GUfCfUfTsT | 1183 | AGACfCfCfAAAAGAUfAAAUfGU fTsT | 1184 | AD-14689 |
| 3480-3498 | AcAuUuAuCuUuUgGgUcUTsT | 1185 | P*aGfaCfcCfaAfaAfgAfuAfa AfuGfuTsT | 1186 | AD-14699 |
| 3480-3498 | AcAuUuAuCuUuUgGgUcUTsT | 1187 | AGACfCfCfAAAAGAUfAAAUfGU fTsT | 1188 | AD-14709 |
| 3480-3498 | AfcAfuUfuAfuCfuUfuUfgGfgU fcUfTsT | 1189 | AGACCcaAAagAUAAAuguTsT | 1190 | AD-14719 |
| 3480-3498 | ACfAUfUfUfAUfCfUfUfUfUfGG GUfCfUfTsT | 1191 | AGACCcaAAagAUAAAuguTsT | 1192 | AD-14729 |
| 3480-3498 | AcAuUuAuCuUuUgGgUcUTsT | 1193 | AGACCcaAAagAUAAAuguTsT | 1194 | AD-14739 |
| 3480-3498 | GfcCfaUfcUfgCfuGfcCfgGfaG fcCfTsT | 1195 | P*gGfcUfcCfgGfcAfgCfaGfa UfgGfcTsT | 1196 | AD-15085 |
| 3480-3498 | GCfCfaUfcUfgCfuGfcCfgGfaG GCfCfTsT | 1197 | GGCfUfCfCfGGCfAGCfAGAUfG GCfTsT | 1198 | AD-15095 |
| 3480-3498 | GcCaUcUgCuGcCgGaGcCTsT | 1199 | P*gGfcUfcCfgGfcAfgCfaGfa UfgGfcTsT | 1200 | AD-15105 |
| 3480-3498 | GcCaUcUgCuGcCgGaGcCTsT | 1201 | GGCfUfCfCfGGCfAGCfAGAUfG GCfTsT | 1202 | AD-15115 |
| 3480-3498 | GfcCfaUfcUfgCfuGfcCfgGfaG fcCfTsT | 1203 | GGCUCauGCagCAGAUggcTsT | 1204 | AD-15125 |
| 3480-3498 | GCfCfAUfCfUfGCfUfGCfCfGGA GCfCfTsT | 1205 | GGCUCauGCagCAGAUggcTsT | 1206 | AD-15135 |
| 3480-3498 | GcCaUcUgCuGcCgGaGcCTsT | 1207 | GGCUCauGCagCAGAUggcTsT | 1208 | AD-15145 |
| 3481-3499 | CAUUUAUCUUUUGGGUCUGTsT | 1209 | CAGACCCAAAAGAUAAAUGTsT | 1210 | AD-9578 |
| 3481-3499 | cAuuuAucuuuuGGGucuGTsT | 1211 | cAGACCcAAAAGAuAAAUGTsT | 1212 | AD-9704 |
| 3485-3503 | UAUCUUUUGGGUCUGUCCUTsT | 1213 | AGGACAGACCCAAAAGAUATsT | 1214 | AD-9558 |
| 3485-3503 | uAucuuuuGGGucuGuccuTsT | 1215 | AGGAcAGACCcAAAAGAuATsT | 1216 | AD-9684 |
| 3504-3522 | CUCUGUUGCCUUUUUACAGTsT | 1217 | CUGUAAAAGGCAACAGAGTsT | 1218 | AD-9634 |
| 3504-3522 | cucuGuuGccuuuuuAcAGTsT | 1219 | CUGuAAAAGGcAAcAGAGTsT | 1220 | AD-9760 |
| 3512-3530 | CCUUUUUACAGCCAACUUUTT | 1221 | AAAGUUGGCUGUAAAAAGGTT | 1222 | AD-15411 |
| 3521-3539 | AGCCAACUUUUCUAGACCUTT | 1223 | AGGUCUAGAAAAGUUGGCUTT | 1224 | AD-15266 |
| 3526-3544 | ACUUUUCUAGACCUGUUUUTT | 1225 | AAAACAGGUCUAGAAAAGUTT | 1226 | AD-15382 |
| 3530-3548 | UUCUAGACCUGUUUUGCUUTsT | 1227 | AAGCAAAACAGGUCUAGAATsT | 1228 | AD-9554 |
| 3530-3548 | uucuAGAccuGuuuuGcuuTsT | 1229 | AAGcAAAAcAGGUCuAGAATsT | 1230 | AD-9680 |
| 3530-3548 | UfuCfuAfgAfcCfuGfuUfuUfgC fuUfTsT | 1231 | P*aAfgCfaAfaAfcAfgGfuCfu AfgAfaTsT | 1232 | AD-14676 |
| 3530-3548 | UfUfCfUfAGACfCfUfGUfUfUfU fGCfUfUfTsT | 1233 | AAGCfAAAACfAGGUfCfUfAGAA TsT | 1234 | AD-14686 |
| 3530-3548 | UuCuAgAcCuGuUuUgCuUTsT | 1235 | P*aAfgCfaAfaAfcAfgGfuCfu AfgAfaTsT | 1236 | AD-14696 |
| 3530-3548 | UuCuAgAcCuGuUuUgCuUTsT | 1237 | AAGCfAAAACfAGGUfCfUfAGAA TsT | 1238 | AD-14706 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 3530-3548 | UfuCfuAfgAfcCfuGfuUfuUffCfuUfTsT | 1239 | AAGcAaaACagGUCUAgaaTsT | 1240 | AD-14716 |
| 3530-3548 | UfUfCfUfAGACfCfUfGUfUfUfUfGCfUfUfTsT | 1241 | AAGcAaaACagGUCUAgaaTsT | 1242 | AD-14726 |
| 3530-3548 | UuCuAgAcCuGuUuUgCuUTsT | 1243 | AAGcAaaACagGUCUAgaaTsT | 1244 | AD-14736 |
| 3530-3548 | CfaUfaGfgCfcCfugGfaGfuUfuAfuUfTsT | 1245 | P*aAfuAfaAfcUfcCfaGfgCfcUfaUfgTsT | 1246 | AD-15082 |
| 3530-3548 | CfAUfAGGCfCfUfGGAGUfUfUfAUfUfTsT | 1247 | AAUfAAACfUfCfCfAGGCfCfUfAUfGTsT | 1248 | AD-15092 |
| 3530-3548 | CaUaGgCcUgGaGuUuAuUTsT | 1249 | P*aAfuAfaAfcUfcCfaGfgCfcUfaUfgTsT | 1250 | AD-15102 |
| 3530-3548 | CaUaGgCcUgGaGuUuAuUTsT | 1251 | AAUfAAACfUfCfCfAGGCfCfUfAUfGTsT | 1252 | AD-15112 |
| 3530-3548 | CfaUfaGfgCfcCfugGfaGfuUfuAfuUfTsT | 1253 | AAUAAacUCcaGGCCUaugTsT | 1254 | AD-15122 |
| 3530-3548 | CfAUfAGGCfCfUfGGAGUfUfUfAUfUfTsT | 1255 | AAUAAacUCcaGGCCUaugTsT | 1256 | AD-15132 |
| 3530-3548 | CaUaGgCcUgGaGuUuAuUTsT | 1257 | AAUAAacUCcaGGCCUaugTsT | 1258 | AD-15142 |
| 3531-3549 | UCUAGACCUGUUUUGCUUUTsT | 1259 | AAAGCAAAACAGGUCUAGATsT | 1260 | AD-9553 |
| 3531-3549 | ucuAGAccuGuuuuGcuuuTsT | 1261 | AAAGcAAAAcAGGUCuAGATsT | 1262 | AD-9679 |
| 3531-3549 | UfcUfaGfaCfcUfgUfuUfuGfcUfuUfTsT | 1263 | P*aAfaGfcAfaAfaCfaGfgUfcUfaGfaTsT | 1264 | AD-14675 |
| 3531-3549 | UfCfUfAGACfCfUfGUfUfUfUfGCfUfUfTst | 1265 | AAAGCfAAAACfAGGUfCfUfAGATsT | 1266 | AD-14685 |
| 3531-3549 | UcUaGaCcUgUuUuGcUuUTsT | 1267 | P*aAfaGfcAfaAfaCfaGfgUfcUfaGfaTsT | 1268 | AD-14695 |
| 3531-3549 | UcUaGaCcUgUuUuGcUuUTsT | 1269 | AAAGCfAAAACfAGGUfCfUfAGATsT | 1270 | AD-14705 |
| 3531-3549 | UfcUfaGfaCfcUfgUfuUfuGfcUfuUfTsT | 1271 | AAAGCaaAAcaGGUCUagaTsT | 1272 | AD-14715 |
| 3531-3549 | UfCfUfAGACfCfUfGUfUfUfUfGCfUfUfTsT | 1273 | AAAGCaaAAcaGGUCUagaTsT | 1274 | AD-14725 |
| 3531-3549 | UcUaGaCcUgUuUuGcUuUTsT | 1275 | AAAGCaaAAcaGGUCUagaTsT | 1276 | AD-14735 |
| 3531-3549 | UfcAfuAfgGfcCfuGfgAfgUfuUfaUfTsT | 1277 | P*aUfaAfaCfuCfcAfgGfcCfuAfuGfaTsT | 1278 | AD-15081 |
| 3531-3549 | ufCfAUfAGGCfCfUfGGAGUfUfUfAUfTsT | 1279 | AUfAAACfUfCfCfAGGCfCfUfAUfGATsT | 1280 | AD-15091 |
| 3531-3549 | UcAuAgGcCuGgAgUuUaUTsT | 1281 | P*aUfaAfaCfuCfcAfgGfcCfuAfuGfaTsT | 1282 | AD-15101 |
| 3531-3549 | UcAuAgGcCuGgAgUuUaUTsT | 1283 | AUfAAACfUfCfCfAGGCfCfUfAUfGATsT | 1284 | AD-15111 |
| 3531-3549 | UfcAfuAfgGfcCfuGfgAfgUfuUfaUfTsT | 1285 | AUAAcuCCagGCCUaugaTsT | 1286 | AD-15121 |
| 3531-3549 | UfCfAUfAGGCfCfUfGGAGUfUfUfAUfTsT | 1287 | AUAAcuCCagGCCUaugaTsT | 1288 | AD-15131 |
| 3531-3549 | UcAuAgGcCuGgAgUuUaUTsT | 1289 | AUAAcuCCagGCCUaugaTsT | 1290 | AD-15141 |
| 3557-3575 | UGAAGAUAUUUAUUCUGGGTsT | 1291 | CCCAGAAUAAAUAUCUUCATsT | 1292 | AD-9626 |
| 3557-3575 | uGAAGAuAuuuAuucuGGGTsT | 1293 | CCcAGAAuAAAuAUCUUcATsT | 1294 | AD-9752 |

TABLE 4 -continued

Sequences of siRNA targeted to PCSK9

| *Target | Sense strand (5'-3')[1] | SEQ ID NO: | Antisense strand (5'-3')[1] | SEQ ID NO: | Duplex # |
|---|---|---|---|---|---|
| 3570-3588 | UCUGGGUUUUGUAGCAUUUTsT | 1295 | AAAUGCUACAAAACCCAGATsT | 1296 | AD-9629 |
| 3570-3588 | ucuGGGuuuuGuAGcAuuuTsT | 1297 | AAAUGCuAcAAAACCcAGATsT | 1298 | AD-9755 |
| 3613-3631 | AUAAAAACAAACAAACGUUTT | 1299 | AACGUUUGUUUGUUUUAUTT | 1300 | AD-15412 |
| 3617-3635 | AAACAAACAAACGUUGUCCTT | 1301 | GGACAACGUUUGUUUGUUUTT | 1302 | AD-15211 |
| 3618-3636 | AACAAACAAACGUUGUCCUTT | 1303 | AGGACAACGUUUGUUUGUUTT | 1304 | AD-15300 |

*Target: target in human PCSK9 gene, access. # NM_174936
U, C, A, G: corresponding ribonucleotide; T: deoxythymidine; u, c, a, g: corresponding 2'-O-methyl ribonucleotide; Uf, Cf Af, Gf: corresponding 2'-deoxy-2'-fluoro ribonucleotide; where nucleotides are written in sequence, they are connected by 3'-5' phosphodiester groups; nucleotides with interjected "s" are connected by 3'-O-5'-O phosphorothiodiester groups; unless denoted by prefix "P*", oligonucleotides are devoid of a 5'-phosphate group on the 5'-most nucleotide; all oligonucleotides bear 3'-OH on the 3'-most nucleotide.

TABLE 5

Sequences of modified dsRNA targeted to PCSK9

| Duplex # | Sense strand sequence (5'-3') | SEQ ID NO: | Antisense-strand sequence (5'-3')[1] | SEQ ID NO: |
|---|---|---|---|---|
| AD-10792 | GccuGGAGuuuAuucGGAATsT | 1305 | UUCCGAAuAAACUCcAGGCTsT | 1306 |
| AD-10793 | GccuGGAGuuuAuucGGAATsT | 1307 | uUcCGAAuAAACUccAGGCTsT | 1308 |
| AD-10796 | GccuGGAGuuuAuucGGAATsT | 1309 | UUCCGAAUAAACUCCAGGCTsT | 1310 |
| AD-12038 | GccuGGAGuuuAuucGGAATsT | 1311 | uUCCGAAUAAACUCCAGGCTsT | 1312 |
| AD-12039 | GccuGGAGuuuAuucGGAATsT | 1313 | UuCCGAAUAAACUCCAGGCTsT | 1314 |
| AD-12040 | GccuGGAGuuuAuucGGAATsT | 1315 | UUcCGAAUAAACUCCAGGCTsT | 1316 |
| AD-12041 | GccuGGAGuuuAuucGGAATsT | 1317 | UUCcGAAUAAACUCCAGGCTsT | 1318 |
| AD-12042 | GCCUGGAGUUUAUUCGGAATsT | 1319 | uUCCGAAUAAACUCCAGGCTsT | 1320 |
| AD-12043 | GCCUGGAGUUUAUUCGGAATsT | 1321 | UuCCGAAUAAACUCCAGGCTsT | 1322 |
| AD-12044 | GCCUGGAGUUUAUUCGGAATsT | 1323 | UUcCGAAUAAACUCCAGGCTsT | 1324 |
| AD-12045 | GCCUGGAGUUUAUUCGGAATsT | 1325 | UUCcGAAUAAACUCCAGGCTsT | 1326 |
| AD-12046 | GccuGGAGuuuAuucGGAA | 1327 | UUCCGAAUAAACUCCAGGCscsu | 1328 |
| AD-12047 | GccuGGAGuuuAuucGGAAA | 1329 | UUUCCGAAUAAACUCCAGGCscsu | 1330 |
| AD-12048 | GccuGGAGuuuAuucGGAAAA | 1331 | UUUUCCGAAUAAACUCCAGGCscsu | 1332 |
| AD-12049 | GccuGGAGuuuAuucGGAAAAG | 1333 | CUUUUCCGAAUAAACUCCAGGCscsu | 1334 |
| AD-12050 | GccuGCAGuuuAuucGGAATTab | 1335 | UUCCGAAUAAACUCCAGGCTTab | 1336 |
| AD-12051 | GccuGGAGuuuAuucGGAAATTab | 1337 | UUUCCGAAuAAACUCCAGGCTTab | 1338 |
| AD-12052 | GccuGGAGuuuAuucGGAAAATTab | 1339 | UUUUCCGAAUAAACUCCAGGCTTab | 1340 |
| AD-12053 | GccuGGAGuuuAuucGGAAAAGTTab | 1341 | CUUUUCCGAAUAAACUCCAGGCTTab | 1342 |
| AD-12054 | GCCUGGAGUUUAUUCGGAATsT | 1343 | UUCCGAAUAAACUCCAGGCscsu | 1344 |
| AD-12055 | GccuGGAGuuuAuucGGAATsT | 1345 | UUCCGAAUAAACUCCAGGCscsu | 1346 |
| AD-18056 | CcCuGgAgUuUaUuCgGaA | 1347 | UUCCGAAUAAACUCCAGGCTTab | 1348 |
| AD-12057 | GcCuGgAgUuUaUuCgGaA | 1349 | UUCCGAAUAAACUCCAGGCTsT | 1350 |
| AD-12058 | GcCuGgAgUuUaUuCgGaA | 1351 | UUCCGAAuAAACUCcAGGCTsT | 1352 |

TABLE 5-continued

Sequences of modified dsRNA targeted to PCSK9

| Duplex # | Sense strand sequence (5'-3') | SEQ ID NO: | Antisense-strand sequence (5'-3')[1] | SEQ ID NO: |
|---|---|---|---|---|
| AD-12059 | GcCuGgAgUuUaUuCgGaA | 1353 | uUcCGAAuAAACUccAGGCTsT | 1354 |
| AD-12060 | GcCuGgAgUuUaUuCgGaA | 1355 | UUCCGaaUAaaCUCCAggc | 1356 |
| AD-12061 | GcCuGgnAgUuUaUuCgGaATsT | 1357 | UUCCGaaUAaaCUCCAggcTsT | 1358 |
| AD-12062 | GcCuGgAgUuUaUuCgGaATTab | 1359 | UUCCGaaUAaaCUCCAggcTTab | 1360 |
| AD-12063 | GcCuGgAgUuUaUuCgGaA | 1361 | UUCCGaaUAaaCUCCAggcscsu | 1362 |
| AD-12064 | GcCuGgnAgUuUaUuCgGaATsT | 1363 | UUCCGAAuAAACUCCAGGCTsT | 1364 |
| AD-12065 | GcCuGgAgUuUaUuCgGaATTab | 1365 | UUCCGAAuAAACUCcAGGCTTab | 1366 |
| AD-12066 | GcCuGgnAgUuUaUuCgGaA | 1367 | UUCCGAAuAAACUCcAGGCsesu | 1368 |
| AD-12067 | GcCuGgnAgUuUaUuCgGaATsT | 1369 | UUCCGAAUAAACUCCACGCTsT | 1370 |
| AD-12068 | GcCuGgnAgUuUaUuCgGaATTab | 1371 | UUCCGAAUAAACUCCAGGCTTab | 1372 |
| AD-12069 | GcCuGgAgUuUaUuCgGaA | 1373 | UUCCGAAUAAACUCCAGGCscsu | 1374 |
| AD-12338 | GfcCfuGfgAfgUfuUfaUfuCfgGfaAf | 1375 | P*uUfcCfgAfaUfaAfaCfuCfcAfgGfc | 1376 |
| AD-12339 | GcCuGgAgUuUaUuCgGaA | 1377 | P*uUfcCfgAfaUfaAfaCfuCfcAfgGfc | 1378 |
| AD-12340 | GccuGGAGuuuAuucGGAA | 1379 | P*uUfcCfgAfaUfaAfaCfuCfcAfgGfc | 1380 |
| AD-12341 | GfcCfuGfgAfgUfuUfaUfuCfgGfaAfTsT | 1381 | P*uUfcCfgAfaUfaAfaCfuCfcAfgGfcTsT | 1382 |
| AD-12342 | GfcCfuGfgAfgUfuUfaUfuCfgGfaAfTsT | 1383 | UUCCGAAuAAACUCcAGGCTsT | 1384 |
| AD-12343 | GfcCfuGfgAfgUfuUfaUfuCfgGfaAfTsT | 1385 | uUcCGAAuAAACUccAGGCTsT | 1386 |
| AD-12344 | GfcCfuGfgAfgUfuUfaUfuCfgGfaAfTsT | 1387 | UUCCGAAUAAACUCCAGGCTsT | 1388 |
| AD-12345 | GfcCfuGfgAfgUfuUfaUfuCfgGfaAfTsT | 1389 | UUCCGAAUAAACUCCAGGCscsu | 1390 |
| AD-12346 | GfcCfuGfgAfgUfuUfaUfuCfgGfaAfTsT | 1391 | UUCCGaaUAaaCUCCAggcscsu | 1392 |
| AD-12347 | GCCUGGAGUUUAUUCGGAATsT | 1393 | P*uUfcCfgAfaUfaAfaCfuCfcAfgGfcTsT | 1394 |
| AD-12348 | GccuGGAGuuuAuucGGAATsT | 1395 | P*uUfcCfgAfaUfaAfaCfuCfcAfgGfcTsT | 1396 |
| AD-12349 | GcCuGgnAgUuUaUuCgGaATsT | 1397 | P*uUfcCfgAfaUfaAfaCfuCfcAfgGfcTsT | 1398 |
| AD-12350 | GfcCfuGfgAfgUfuUfaUfuCfgGfaAfTTab | 1399 | P*uUfcCfgAfaUfaAfaCfuCfcAfgGfcTTab | 1400 |
| AD-12351 | GfcCfuGfgAfgUfuUfaUfuCfgGfaAf | 1401 | P*uUfcCfgAfaUfaAfaCfuCfcAfgGfcsCfsu | 1402 |
| AD-12352 | GfcCfuGfgAfgUfuUfaUfuCfgGfaAf | 1403 | UUCCGaaUAaaCUCCAggcscsu | 1404 |
| AD-12354 | GfcCfuGfgAfgUfuUfaUfuCfgGfaAf | 1405 | UUCCGAAUAAACUCCAGGCscsu | 1406 |
| AD-12355 | GfcCfuGfgAfgUfuUfaUfuCfgGfaAf | 1407 | UUCCGAAuAAACUCcAGGCTsT | 1408 |
| AD-12356 | GfcCfuGfgAfgUfuUfaUfuCfgGfaAf | 1409 | uUcCGAAuAAACUccAGGCTsT | 1410 |

TABLE 5-continued

Sequences of modified dsRNA targeted to PCSK9

| Duplex # | Sense strand sequence (5'-3') | SEQ ID NO: | Antisense-strand sequence (5'-3')[1] | SEQ ID NO: |
|---|---|---|---|---|
| AD-12357 | GmocCmouGmogAmo2gUmouUmoaUmouCmogGmoaA | 1411 | UUCCGaaUAaaCUCCAggc | 1412 |
| AD-12358 | GmocCmouGmogAmo2gUmouUmoaUmouCmogGmoaA | 1413 | P*uUfcCfgAfaUfaAfaCfuCfcAfgGfc | 1414 |
| AD-12359 | GmocCmouGmogAmo2gUmouUmoaUmouCmogGmoaA | 1415 | P*uUfcCfgAfaUfaAfaCfuCfcAfgGfcsCfsu | 1416 |
| AD-12360 | GmocCmouGmogAmo2gUmouUmoaUmouCmogGmoaA | 1417 | UUCCGAAUAAACUCCAGGCscsu | 1418 |
| AD-12361 | GmocCmouGmogAmo2gUmouUmoaUmouCmogGmoaA | 1419 | UUCCGAAuAAACUCCaGGCTsT | 1420 |
| AD-12362 | GmocCmouGmogAmo2gUmouUmoaUmouCmogGmoaA | 1421 | uUcCGAAuAAACUccAGGCTsT | 1422 |
| AD-12363 | GmocCmouGmogAmo2gUmouUmoaUmouCmogGmoaA | 1423 | UUCCGaaUAaaCUCCAggcscsu | 1424 |
| AD-12364 | GmocCmouGmogAmogUmouUmoaUmouCmogGmoaATsT | 1425 | UUCCGaaUAaaCUCCAggcTsT | 1426 |
| AD-12365 | GmocCmouGmogAmogUmouUmoaUmouCmogGmoaATsT | 1427 | UUCCGAAuAAACUCcAGGCTsT | 1428 |
| AD-12366 | GmocCmouGmogAmogUmouUmoaUmouCmogGmoaATsT | 1429 | UUCCGAAUAAACUCCAGGCTsT | 1430 |
| AD-12367 | GmocmocmouGGAGmoumoumouAmoumoumocGGAATsT | 1431 | UUCCGaaUAaaCUCCAggcTsT | 1432 |
| AD-12368 | GmocmocmouGGAGmoumoumouAmoumoumocGGAATsT | 1433 | UUCCGAAuAAACUCcAGGCTsT | 1434 |
| AD-12369 | GmocmocmouGGAGmoumoumouAmoumoumocGGAATsT | 1435 | UUCCGAAUAAACUCCAGGCTsT | 1436 |
| AD-12370 | GmocmocmouGGAGmoumoumouAmoumoumocGGAATsT | 1437 | P*UfUfCfCfGAAUfAAACfUfCfCfAGGCfTsT | 1438 |
| AD-12371 | GmocmocmouGGAGmoumoumouAmoumoumocGGAATsT | 1439 | P*UfUfCfCfGAAUfAAACfUfCfCfAGGCfsCfsUf | 1440 |
| AD-12372 | GmocmocmouGGAGmoumoumouAmoumoumocGGAATsT | 1441 | P*uUfcCfgAfaUfaAfaCfuCfcAfgGfcsCfsu | 1442 |
| AD-12373 | GmocmocmouGGAGmoumoumouAmoumoumocGGAATsT | 1443 | UUCCGAAUAAACUCCAGGCTsT | 1444 |
| AD-12374 | GCfCfUfGGAGUfUfUfAUfUfCfGGAATsT | 1445 | UfUfCfCfGAAUfAAACfUfCfCfAGGCfTsT | 1446 |
| AD-12375 | GCfCfUfGGAGUfUfUfAUfUfCfGGAATsT | 1447 | UUCCGAAUAAACUCCAGGCTsT | 1448 |
| AD-12377 | GCfCfUfGGAGUfUfUfAUfUfCfGGAATsT | 1449 | uUcCGAAuAAACUccAGGCTsT | 1450 |
| AD-12378 | GCfCfUfGGAGUfUfUfAUfUfCfGGAATsT | 1451 | UUCCCaaUAaaCUCCaGGcscsu | 1452 |
| AD-12379 | GCfCfUfGGAGUfUfUfAUfUfCfGGAATsT | 1453 | UUCCGAAUAAACUCCAGGCscsu | 1454 |
| AD-12380 | GCfCfUfGGAGUfUfUfAUfUfCfGGAATsT | 1455 | P*uUfcCfgAfaUfaAfaCfuCfcAfgGfcsCfsu | 1456 |
| AD-12381 | GCfCfUfGGAGUfUfUfAUfUfCfGGAATsT | 1457 | P*uUfcCfgAfaUfaAfaCfuCfcAfgGfcTsT | 1458 |

TABLE 5-continued

Sequences of modified dsRNA targeted to PCSK9

| Duplex # | Sense strand sequence (5'-3') | SEQ ID NO: | Antisense-strand sequence (5'-3')[1] | SEQ ID NO: |
|---|---|---|---|---|
| AD-12382 | GCfCfUfGGAGUfUfUfAUfUfCfGGAATsT | 1459 | P*UfUfCfCfGAAUfAAACfUfCfCfAGGCfTsT | 1460 |
| AD-12383 | GCCUGGAGUUUAUUCGGAATsT | 1461 | P*UfUfCfCfGAAUfAAACfUfCfCfAGGCfTsT | 1462 |
| AD-12384 | GccuGGAGuuuAuucGGAATsT | 1463 | P*UfUfCfCfGAAUfAAACfUfCfCfAGGCfTsT | 1464 |
| AD-12385 | GcCuGgnAgUuUaUuCgGaATsT | 1465 | P*UfUfCfCfGAAUfAAACfUfCfCfAGGCfTsT | 1466 |
| AD-12386 | GfcCfuGfgAfgUfuUfaUfuCfgGfaAf | 1467 | P*UfUfCfCfGAAUfAAACfUfCfCfAGGCfTsT | 1468 |
| AD-12387 | GCfCfUfGGAGGUfUfUfAUfUfCfGGAA | 1469 | UfUfCfCfGAAUfAAACfUfCfCfAGGCfsCfsUf | 1470 |
| AD-12388 | GCfCfUfGGAGGUfUfUfAUfUfCfGGAA | 1471 | P*uUfcCfgAfaUfaAfaCfuCfcAfgGfc | 1472 |
| AD-12389 | GCfCfUfGGAGGUfUfUfAUfUfCfGGAA | 1473 | P*uUfcCfgAfaUfaAfaCfuCfcAfgGfcsCfsu | 1474 |
| AD-12390 | GCfCfUfGGAGGUfUfUfAUfUfCfGGAA | 1475 | UUCCGAAUAAACUCCAGGCscsu | 1476 |
| AD-12391 | GCfCfUfGGAGGUfUfUfAUfUfCfGGAA | 1477 | UUCCGaaUAaaCUCCAggc | 1478 |
| AD-12392 | GCfCfUfGGAGGUfUfUfAUfUfCfGGAA | 1479 | UUCCGAAUAAACUCCAGGCTsT | 1480 |
| AD-12393 | GCfCfUfGGAGGUfUfUfAUfUfCfGGAA | 1481 | UUCCGAAuAAACUCCAGGCTsT | 1482 |
| AD-12394 | GCfCfUfGGAGGUfUfUfAUfUfCfGGAA | 1483 | uUcCGAAuAAACUccAGGCTsT | 1484 |
| AD-12395 | GmocCmouGmogAmogUmouUmoaUmouCmogGmoaATsT | 1485 | P*UfUfCfCfGAAUfAAACfUfCfCfAGGCfsCfsUf | 1486 |
| AD-12396 | GmocCmouGmogAmo2gUmouUmoaUmouCmogGmoaA | 1487 | P*UfUfCfCfGAAUfAAACfUfCfCfAGGCfsCfsUf | 1488 |
| AD-12397 | GfcCfuGfgAfgUfuUfaUfuCfgGfaAf | 1489 | P*UfUfCfCfGAAUfAAACfUfCfCfAGGCfsCfsUf | 1490 |
| AD-12398 | GfcCfuGfgAfgUfuUfaUfuCfgGfaAfTsT | 1491 | P*UfUfCfCfGAAUfAAACfUfCfCfAGGCfsCfsUf | 1492 |
| AD-12399 | GcCuGgnAgUuUaUuCgGaATsT | 1493 | P*UfUfCfCfGAAUfAAACfUfCfCfAGGCfsCfsUf | 1494 |
| AD-12400 | GCCUGGAGUUUAUUCGGAATsT | 1495 | P*UfUfCfCfGAAUfAAACfUfCfCfAGGCfsCfsUf | 1496 |
| AD-12401 | GccuGGAGuuuAuucGGAATsT | 1497 | P*UfUfCfCfGAAUfAAACfUfCfCfAGGCfsCfsUf | 1498 |
| AD-12402 | GccuGGAGuuuAuucGGAA | 1499 | P*UfUfCfCfGAAUfAAACfUfCfCfAGGCfsCfsUf | 1500 |
| AD-12403 | GCfCfUfGGAGGUfUfUfAUfUfCfGGAA | 1501 | P*UfUfCfCfGAAUfAAACfUfCfCfAGGCfsCfsUf | 1502 |
| AD-9314 | GCCUGGAGUUUAUUCGGAATsT | 1503 | UUCCGAAUAAACUCCAGGCTsT | 1504 |
| AD-10794 | ucAuAGGccuGGAGuuuAudTsdT | 1525 | AuAAACUCCAGGCCuAUGAdTsdT | 1526 |

TABLE 5-continued

Sequences of modified dsRNA targeted to PCSK9

| Duplex # | Sense strand sequence (5'-3') | SEQ ID NO: | Antisense-strand sequence (5'-3')[1] | SEQ ID NO: |
|---|---|---|---|---|
| AD-10795 | ucAuAGGccuGGAGuuuAudTsdT | 1527 | AuAAACUccAGGcCuAuGAdTsdT | 1528 |
| AD-10797 | ucAuAGGccuGGAGuuuAudTsdT | 1529 | AUAAACUCCAGGCCUAUGAdTsdT | 1530 |

U, C, A, G: corresponding ribonucleotide; T: deoxythymidine; u, c, a, g: corresponding 2'-O-methyl ribonucleotide; Uf, Cf, Af, Gf: corresponding 2'-deoxy-2'-fluoro ribonucleotide; where nucleotides are written in sequence, they are connected by 3'-5' phosphodiester groups; nucleotides with interjected "s" are connected by 3'-O-5'-O phosphorothiodiester groups; unless denoted by prefix "P*", oligonucleotides are devoid of a 5'-phosphate group on the 5'-most nucleotide; all oligonucleotides bear 3'-OH on the 3'-most nucleotide.

TABLE 6 dsRNA targeted to PCSK9: mismatches and modifications

| Duplex # | Strand | SEQ ID NO: | Sequence (5' to 3') |
|---|---|---|---|
| AD-9680 | S | 1531 | uucuAGAccuGuuuuGcuudTsdT |
|  | AS | 1532 | AAGcAAAAcAGGUCuAGAAdTsdT |
| AD-3267 | S | 1535 | uucuAGAcCuGuuuuGcuuTsT |
|  | AS | 1536 | AAGcAAAAcAGGUCuAGAATsT |
| AD-3268 | S | 1537 | uucuAGAccUGuuuuGcuuTsT |
|  | AS | 1538 | AAGcAAAAcAGGUCuAGAATsT |
| AD-3269 | S | 1539 | uucuAGAcCUGuuuuGcuuTsT |
|  | AS | 1540 | AAGcAAAAcAGGUCuAGAATsT |
| AD-3270 | S | 1541 | uucuAGAcY1uGuuuuGcuuTsT |
|  | AS | 1542 | AAGcAAAAcAGGUCuAGAATsT |
| AD-3271 | S | 1543 | uucuAGAcY1UGuuuuGcuuTsT |
|  | AS | 1544 | AAGcAAAAcAGGUCuAGAATsT |
| AD-3272 | S | 1545 | uucuAGAccY1GuuuuGcuuTsT |
|  | AS | 1546 | AAGcAAAAcAGGUCuAGAATsT |
| AD-3273 | S | 1547 | uucuAGAcCY1GuuuuGcuuTsT |
|  | AS | 1548 | AAGcAAAAcAGGUCuAGAATsT |
| AD-3274 | S | 1549 | uucuAGAccuY1uuuuGcuuTsT |
|  | AS | 1550 | AAGcAAAAcAGGUCuAGAATsT |
| AD-3275 | S | 1551 | uucuAGAcCUY1uuuuGcuuTsT |
|  | AS | 1552 | AAGcAAAAcAGGUCuAGAATsT |
| AD-14676 | S | 1553 | UfuCfuAfgAfcCfuGfuUfuUfgCfuUfTsT |
|  | AS | 1554 | P*aAfgCfaAfaAfcAfgGfuCfuAfgAfaTsT |
| AD-3276 | S | 1555 | UfuCfuAfgAfcCuGfuUfuUfgCfuUfTsT |
|  | AS | 1556 | P*aAfgCfaAfaAfcAfgGfuCfuAfgAfaTsT |
| AD-3277 | S | 1557 | UfuCfuAfgAfcCfUGfuUfuUfgCfuUfTsT |
|  | AS | 1558 | P*aAfgCfaAfaAfcAfgGfuCfuAfgAfaTsT |
| AD-3278 | S | 1559 | UfuCfuAfgAfcCUGfuUfuUfgCfuUfTsT |
|  | AS | 1560 | P*aAfgCfaAfaAfcAfgGfuCfuAfgAfaTsT |
| AD-3279 | S | 1561 | UfuCfuAfgAfcY1uGfuUfuUfgCfuUfTsT |
|  | AS | 1562 | P*aAfgCfaAfaAfcAfgGfuCfuAfgAfaTST |
| AD-3280 | S | 1563 | UfuCfuAfgAfcY1UGfuUfuUfgCfuUfTsT |
|  | AS | 1564 | P*aAfgCfaAfaAfcAfgGfuCfuAfgAfaTsT |
| AD-3281 | S | 1565 | UfuCfuAfgAfcCfY1GfuUfuUfgCfuUfTsT |
|  | AS | 1566 | P*aAfgCfaAfaAfcAfgGfuCfuAfgAfaTsT |
| AD-3282 | S | 1567 | UfuCfuAfgAfcCY1GfuUfuUfgCfuUfTsT |
|  | AS | 1568 | P*aAfgCfaAfaAfcAfgGfuCfuAfgAfaTsT |
| AD-3283 | S | 1569 | UfuCfuAfgAfcCfuY1uUfuUfgCfuUfTsT |
|  | AS | 1570 | P*aAfgCfaAfaAfcAfgGfuCfuAfgAfaTsT |

TABLE 6-continued dsRNA targeted to PCSK9: mismatches and modifications

| Duplex # | Strand | SEQ ID NO: | Sequence(5' to 3') |
|---|---|---|---|
| AD-3284 | S | 1571 | UfuCfuAfgAfcCUY1uUfuUfgCfuUfTsT |
|  | AS | 1572 | P*aAfgCfaAfaAfcAfgGfuCfuAfgAfaTsT |
| AD-10792 | S | 459 | GccuGGAGuuuAuucGGAATsT |
|  | AS | 460 | UUCCGAAuAAACUCcAGGCTsT |
| AD-3254 | S | 1573 | GccuGGAGuY1uAuucGGAATsT |
|  | AS | 1574 | UUCCGAAuAAACUCcAGGCTsT |
| AD-3255 | S | 1575 | GccuGGAGUY1uAuucGGAATsT |
|  | AS | 1576 | UUCCGAAuAAACUCcAGGCTsT |

Strand: S/Sense; AS/Antisense; U, C, A, G: corresponding ribonucleotide; T: deoxythymidine; u, c, a, g: corresponding 2'-O-methyl ribonucleotide; Uf, Cf, Af, Gf: corresponding 2'-deoxy-2'-fluoro ribonucleotide; Y1 corresponds to DFT difluorotoluyl ribo(or deoxyribo)nucleotide; where nucleotides are written in sequence, they are connected by 3'-5' phosphodiester groups; nucleotides with interjected "s" are connected by 3'-O-5'-O phosphorothioi-ester groups; unless denoted by prefix "P*", oligonucleotides are devoid of a 5'-phosphate group on the 5'-most nucleotide; all oligonucleotides bear 3'-OH on the 3'-most nucleotide

TABLE 7

Sequences of unmodified siRNA flanking AD-9680

| Duplex # | Strand | Sequence (5' to 3') | *Target | SEQ ID NO: |
|---|---|---|---|---|
| AD-22169-b1 | sense | CAGCCAACUUUUCUAGACCdTsdT | 3520 | 1577 |
|  | antis | GGUCUAGAAAAGUUGGCUGdTsdT | 3520 | 1578 |
| AD-22170-b1 | sense | AGCCAACUUUUCUAGACCUdTsdT | 3521 | 1579 |
|  | antis | AGGUCUAGAAAAGUUGGCUdTsdT | 3521 | 1580 |
| AD-22171-b1 | sense | GCCAACUUUUCUAGACCUGdTsdT | 3522 | 1581 |
|  | antis | CAGGUCUAGAAAAGUUGGCdTsdT | 3522 | 1582 |
| AD-22172-b1 | sense | CCAACUUUUCUAGACCUGUdTsdT | 3523 | 1583 |
|  | antis | ACAGGUCUAGAAAAGUUGGdTsdT | 3523 | 1584 |
| AD-22173-b1 | sense | CAACUUUUCUAGACCUGUUdTsdT | 3524 | 1585 |
|  | antis | AACAGGUCUAGAAAAGUUGdTsdT | 3524 | 1586 |
| AD-22174-b1 | sense | AACUUUUCUAGACCUGUUUdTsdT | 3525 | 1587 |
|  | antis | AAACAGGUCUAGAAAAGUUdTsdT | 3525 | 1588 |
| AD-22175-b1 | sense | ACUUUUCUAGACCUGUUUUdTsdT | 3526 | 1589 |
|  | antis | AAAACAGGUCUAGAAAAGUdTsdT | 3526 | 1590 |
| AD-22176-b1 | sense | CUUUUCUAGACCUGUUUUGdTsdT | 3527 | 1591 |
|  | antis | CAAAACAGGUCUAGAAAAGdTsdT | 3527 | 1592 |
| AD-22177-b1 | sense | UUUUCUAGACCUGUUUUGCdTsdT | 3528 | 1593 |
|  | antis | GCAAAACAGGUCUAGAAAAdTsdT | 3528 | 1594 |
| AD-22178-b1 | sense | UUUCUAGACCUGUUUUGCUdTsdT | 3529 | 1595 |
|  | antis | AGCAAAACAGGUCUAGAAAdTsdT | 3529 | 1596 |
| AD-22179-b1 | sense | UCUAGACCUGUUUUGCUUUdTsdT | 3531 | 1597 |
|  | antis | AAAGCAAAACAGGUCUAGAdTsdT | 3531 | 1598 |
| AD-22180-b1 | sense | CUAGACCUGUUUUGCUUUUdTsdT | 3532 | 1599 |
|  | antis | AAAAGCAAAACAGGUCUAGdTsdT | 3532 | 1600 |
| AD-22181-b1 | sense | UAGACCUGUUUUGCUUUUGdTsdT | 3533 | 1601 |
|  | antis | CAAAAGCAAAACAGGUCUAdTsdT | 3533 | 1602 |
| AD-22182-b1 | sense | AGACCUGUUUUGCUUUUGUdTsdT | 3534 | 1603 |
|  | antis | ACAAAAGCAAAACAGGUCUdTsdT | 3534 | 1604 |
| AD-22183-b1 | sense | GACCUGUUUUGCUUUUGUAdTsdT | 3535 | 1605 |
|  | antis | UACAAAAGCAAAACAGGUCdTsdT | 3535 | 1606 |

TABLE 7-continued

Sequences of unmodified siRNA flanking AD-9680

| Duplex # | Strand | Sequence (5' to 3') | *Target | SEQ ID NO: |
|---|---|---|---|---|
| AD-22184-b1 | sense | ACCUGUUUUGCUUUUGUAAdTsdT | 3536 | 1607 |
| | antis | UUACAAAAGCAAAACAGGUdTsdT | 3536 | 1608 |
| AD-22185-b1 | sense | CCUGUUUUGCUUUUGUAACdTsdT | 3537 | 1609 |
| | antis | GUUACAAAAGCAAAACAGGdTsdT | 3537 | 1610 |
| AD-22186-b1 | sense | CUGUUUUGCUUUUGUAACUdTsdT | 3538 | 1611 |
| | antis | AGUUACAAAAGCAAAACAGdTsdT | 3538 | 1612 |
| AD-22187-b1 | sense | UGUUUUGCUUUUGUAACUUdTsdT | 3539 | 1613 |
| | antis | AAGUUACAAAAGCAAAACAdTsdT | 3539 | 1614 |
| AD-22188-b1 | sense | GUUUUGCUUUUGUAACUUGdTsdT | 3540 | 1615 |
| | antis | CAAGUUACAAAAGCAAAACdTsdT | 3540 | 1616 |
| AD-22189-b1 | sense | UUUUGCUUUUGUAACUUGAdTsdT | 3541 | 1617 |
| | antis | UCAAGUUACAAAAGCAAAAdTsdT | 3541 | 1618 |
| AD-22190-b1 | sense | UUUGCUUUUGUAACUUGAAdTsdT | 3542 | 1619 |
| | antis | UUCAAGUUACAAAAGCAAAdTsdT | 3542 | 1620 |
| AD-22191-b1 | sense | UUGCUUUUGUAACUUGAAGdTsdT | 3543 | 1621 |
| | antis | CUUCAAGUUACAAAAGCAAdTsdT | 3543 | 1622 |
| AD-22192-b1 | sense | UGCUUUUGUAACUUGAAGAdTsdT | 3544 | 1623 |
| | antis | UCUUCAAGUUACAAAAGCAdTsdT | 3544 | 1624 |
| AD-22193-b1 | sense | GCUUUUGUAACUUGAAGAUdTsdT | 3545 | 1625 |
| | antis | AUCUUCAAGUUACAAAAGCdTsdT | 3545 | 1626 |
| AD-22194-b1 | sense | CUUUUGUAACUUGAAGAUAdTsdT | 3546 | 1627 |
| | antis | UAUCUUCAAGUUACAAAAGdTsdT | 3546 | 1628 |
| AD-22195-b1 | sense | UUUUGUAACUUGAAGAUAUdTsdT | 3547 | 1629 |
| | antis | AUAUCUUCAAGUUACAAAAdTsdT | 3547 | 1630 |
| AD-22196-b1 | sense | UUUGUAACUUGAAGAUAUUdTsdT | 3548 | 1631 |
| | antis | AAUAUCUUCAAGUUACAAAdTsdT | 3548 | 1632 |
| AD-22197-b1 | sense | UUGUAACUUGAAGAUAUUUdTsdT | 3549 | 1633 |
| | antis | AAAUAUCUUCAAGUUACAAdTsdT | 3549 | 1634 |
| AD-22198-b1 | sense | UGUAACUUGAAGAUAUUUAdTsdT | 3550 | 1635 |
| | antis | UAAAUAUCUUCAAGUUACAdTsdT | 3550 | 1636 |
| AD-22199-b1 | sense | GUAACUUGAAGAUAUUUAUdTsdT | 3551 | 1637 |
| | antis | AUAAAUAUCUUCAAGUUACdTsdT | 3551 | 1638 |
| AD-22200-b1 | sense | UAACUUGAACAUAUUUAUUdTsdT | 3552 | 1639 |
| | antis | AAUAAAUAUCUUCAAGUUAdTsdT | 3552 | 1640 |
| AD-22201-b1 | sense | AACUUGAAGAUAUUUAUUCdTsdT | 3553 | 1641 |
| | antis | GAAUAAAUAUCUUCAAGUUdTsdT | 3553 | 1642 |
| AD-22202-b1 | sense | ACUUGAAGAUAUUUAUUCUdTsdT | 3554 | 1643 |
| | antis | AGAAUAAAUAUCUUCAAGUdTsdT | 3554 | 1644 |
| AD-22203-b1 | sense | CUUGAAGAUAUUUAUUCUGdTsdT | 3555 | 1645 |
| | antis | CAGAAUAAAUAUCUUCAAGdTsdT | 3555 | 1646 |
| AD-22204-b1 | sense | UUGAAGAUAUUUAUUCUGGdTsdT | 3556 | 1647 |
| | antis | CCAGAAUAAAUAUCUUCAAdTsdT | 3556 | 1648 |
| AD-22205-b1 | sense | UGAAGAUAUUUAUUCUGGGdTsdT | 3557 | 1649 |
| | antis | CCCAGAAUAAAUAUCUUCAdTsdT | 3557 | 1650 |
| AD-22206-b1 | sense | GAAGAUAUUUAUUCUGGGUdTsdT | 3558 | 1651 |
| | antis | ACCCAGAAUAAAUAUCUUCdTsdT | 3558 | 1652 |

*Target: target in human PCSK9 gene, access. # NM_174936
U, C, A, G: corresponding ribonucleotide; dT: deoxythymidine; where nucleotides are written in sequence, they are connected by 3'-5' phosphodiester groups; nucleotides with interjected "s" are connected by 3'-O-5'-O phosphorothiodiester groups.

TABLE 8

Sequences of modified siRNA flanking AD-9680

| Duplex # | Strand | Sequence(5' to 3') | *Target | SEQ ID NO: |
|---|---|---|---|---|
| AD-22098-b1 | sense | cAGccAAcuuuucuAGAccdTsdT | 3520 | 1653 |
| | antis | GGUCuAGAAAAGUUGGCUGdTsdT | 3520 | 1654 |
| AD-22099-b1 | sense | AGccAAcuuuucuAGAccudTsdT | 3521 | 1655 |
| | antis | AGGUCuAGAAAAGUUGGCUdTsdT | 3521 | 1656 |
| AD-22100-b1 | sense | GccAAcuuuucuAGAccuGdTsdT | 3522 | 1657 |
| | antis | cAGGUCuAGAAAAGUUGGCdTsdT | 3522 | 1658 |
| AD-22101-b1 | sense | ccAAcuuuucuAGAccuGudTsdT | 3523 | 1659 |
| | antis | AcAGGUCuAGAAAAGUUGGdTsdT | 3523 | 1660 |
| AD-22102-b1 | sense | cAAcuuuucuAGAccuGuudTsdT | 3524 | 1661 |
| | antis | AAcAGGUCuAGAAAAGUUGdTsdT | 3524 | 1662 |
| AD-22103-b1 | sense | AAcuuuucuAGAccuGuuudTsdT | 3525 | 1663 |
| | antis | AAAcAGGUCuAGAAAAGUUdTsdT | 3525 | 1664 |
| AD-22104-b1 | sense | AcuuuucuAGAccuGuuuudTsdT | 3526 | 1665 |
| | antis | AAAAcAGGUCuAGAAAAGUdTsdT | 3526 | 1666 |
| AD-22105-b1 | sense | cuuuucuAGAccuGuuuuGdTsdT | 3527 | 1667 |
| | antis | cAAAAcAGGUCuAGAAAAGdTsdT | 3527 | 1668 |
| AD-22106-b1 | sense | uuuucuAGAccuGuuuuGcdTsdT | 3528 | 1669 |
| | antis | GcAAAAcAGGUCuAGAAAAdTsdT | 3528 | 1670 |
| AD-22107-b1 | sense | uuucuAGAccuGuuuuGcudTsdT | 3529 | 1671 |
| | antis | AGcAAAAcAGGUCuAGAAAdTsdT | 3529 | 1672 |
| AD-22108-b1 | sense | ucuAGAccuGuuuuGcuuudTsdT | 3531 | 1673 |
| | antis | AAAGcAAAAcAGGUCuAGAdTsdT | 3531 | 1674 |
| AD-22109-b1 | sense | cuAGAccuGuuuuGcuuuudTsdT | 3532 | 1675 |
| | antis | AAAAGcAAAAcAGGUCuAGdTsdT | 3532 | 1676 |
| AD-22110-b1 | sense | uAGAccuGuuuuGcuuuuGdTsdT | 3533 | 1677 |
| | antis | cAAAAGcAAAAcAGGUCuAdTsdT | 3533 | 1678 |
| AD-22111-b1 | sense | AGAccuGuuuuGcuuuuGudTsdT | 3534 | 1679 |
| | antis | AcAAAAGcAAAAcAGGUCUdTsdT | 3534 | 1680 |
| AD-22112-b1 | sense | GAccuGuuuuGcuuuuGuAdTsdT | 3535 | 1681 |
| | antis | uAcAAAAGcAAAAcAGGUCdTsdT | 3535 | 1682 |
| AD-22113-b1 | sense | AccuGuuuuGcuuuuGuAAdTsdT | 3536 | 1683 |
| | antis | UuAcAAAAGcAAAAcAGGUdTsdT | 3536 | 1684 |
| AD-22114-b1 | sense | ccuGuuuuGcuuuuGuAAcdTsdT | 3537 | 1685 |
| | antis | GUuAcAAAAGcAAAAcAGGdTsdT | 3537 | 1686 |
| AD-22115-b1 | sense | cuGUuuuGcuuuuGuAAcudTsdT | 3538 | 1687 |
| | antis | AGUuAcAAAAGcAAAAcAGdTsdT | 3538 | 1688 |
| | sense | uGuuuuGcuuuuGuAAcuudTsdT | 3539 | 1689 |
| | antis | AAGUuAcAAAAGcAAAAcAdTsdT | 3539 | 1690 |
| AD-22116-b1 | sense | GuuuuGcuuuuGuAAcuuGdTsdT | 3540 | 1691 |
| | antis | cAAGUuAcAAAAGcAAAACdTsdT | 3540 | 1692 |
| AD-22117-b1 | sense | uuuuGcuuuuGuAAcuuGAdTsdT | 3541 | 1693 |
| | antis | UcAAGUuAcAAAAGcAAAAdTsdT | 3541 | 1694 |
| AD-22118-b1 | sense | uuuGcuuuuGuAAcuuGAGdTsdT | 3542 | 1695 |
| | antis | UUcAAGUuAcAAAAGcAAAdTsdT | 3542 | 1696 |
| AD-22119-b1 | sense | uuGcuuuuGuAAcuuGAAGdTsdT | 3543 | 1997 |
| | antis | CUUcAAGUuAcAAAAGcAAdTsdT | 3543 | 1698 |
| AD-22120-b1 | sense | uGcuuuuGuAAcuuGAAGAdTsdT | 3544 | 1699 |
| | antis | UCUUcAAGUuAcAAAAGcAdTsdT | 3544 | 1700 |
| AD-22121-b1 | sense | GcuuuuGuAAcuuGAAGAudTsdT | 3545 | 1701 |
| | antis | AUCUUcAAGUuAcAAAAGCdTsdT | 3545 | 1702 |
| AD-22122-b1 | sense | cuuuuGuAAcuuGAAGAuAdTsdT | 3546 | 1703 |
| | antis | uAUCUUcAAGUuAcAAAAGdTsdT | 3546 | 1704 |

TABLE 8 -continued

Sequences of modified siRNA flanking AD-9680

| Duplex # | Strand | Sequence(5' to 3') | *Target | SEQ ID NO: |
|---|---|---|---|---|
| AD-22123-b1 | sense | uuuuGuAAcuuGAAGAuAudTsdT | 3547 | 1705 |
|  | antis | AuAUCUUcAAGUuAcAAAAdTsdT | 3547 | 1706 |
| AD-22124-b1 | sense | uuuGuAAcuuGAAGAuAuudTsdT | 3548 | 1707 |
|  | antis | AAuAUCUUcAAGUuAcAAAdTsdT | 3548 | 1708 |
| AD-22125-b1 | sense | uuGuAAcuuGAAGAuAuuudTsdT | 3549 | 1709 |
|  | antis | AAAuAUCUUcAAGUuAcAAdTsdT | 3549 | 1710 |
| AD-22126-b1 | sense | uGuAAcuuGAAGAuAuuuAdTsdT | 3550 | 1711 |
|  | antis | uAAAuAUCUUcAAGUuAcAdTsdT | 3550 | 1712 |
| AD-22127-b1 | sense | GuAAcuuGAAGAuAuuuAudTsdT | 3551 | 1713 |
|  | antis | AuAAAuAUCUUcAAGUuACdTsdT | 3551 | 1714 |
| AD-22128-b1 | sense | uAAcuuGAAGAuAuuuAuudTsdT | 3552 | 1715 |
|  | antis | AAuAAAuAUCUUcAAGUuAdTsdT | 3552 | 1716 |
| AD-22129-b1 | sense | AAcuuGAAGAuAuuuAuucdTsdT | 3553 | 1717 |
|  | antis | GAAuAAAuAUCUUcAAGUUdTsdT | 3553 | 1718 |
| AD-22130-b1 | sense | AcuuGAAGAuAuuuAuucudTsdT | 3554 | 1719 |
|  | antis | AGAAuAAAuAUCUUcAAGUdTsdT | 3554 | 1720 |
| AD-22131-b1 | sense | cuuGAAGAuAuuuAuucuGdTsdT | 3555 | 1721 |
|  | antis | cAGAAuAAAuAUCUUcAAGdTsdT | 3555 | 1722 |
| AD-22132-b1 | sense | uuGAAGAuAuuuAuucuGGdTsdT | 3556 | 1723 |
|  | antis | CcAGAAuAAAuAUCUUcAAdTsdT | 3556 | 1724 |
| AD-22133-b1 | sense | uGAAGAuAuuuAuucuGGGdTsdT | 3557 | 1725 |
|  | antis | CCcAGAAuAAAuAUCUUcAdTsdT | 3557 | 1726 |
| AD-22134-b1 | sense | GAAGAuAuuuAuucuGGGudTsdT | 3558 | 1727 |
|  | antis | ACCcAGAAuAAAuAUCUUCdTsdT | 3558 | 1728 |

*Target: 5' nucleotide of target sequence in human PCSK9 gene, access.
NM_174936 U, C, A, G: corresponding ribonucleotide; dT: deoxythymidine; u, c, a, g: corresponding 2'-O-methyl ribonucleotide; Uf, Cf, Af, Gf: corresponding 2'-deoxy-2'-fluoro ribonucleotide; Y1 corresponds to DFT difluorotoluyl ribo(or deoxyribo)nucleotide; where nucleotides are written in sequence, they are connected by 3'-5' phosphodiester groups; nucleotides with interjected "s" are connected by 3'-O-5'-O phosphorothiodiester groups; unless denoted by prefix "P*", oligonucleotides are devoid of a 5'-phosphate group on the 5'-most nucleotide; all oligonucleotides bear 3'-OH on the 3'-most nucleotide

TABLE 9

Sequences of XBP-1 dsRNAs

| Target* | SEQ ID NO | sense (5'-3') | SEQ ID NO | antisense (5'-3') |
|---|---|---|---|---|
| NM_001004210 1128-1146 | 1729 | CCCAGCUGAUUAGUGUCUA | 1753 | UAGACACUAAUCAGCUGGG |
| NM_001004210 1129-1147 | 1730 | CCAGCUGAUUAGUGUCUAA | 1754 | UUAGACACUAAUCAGCUGG |
| NM_001004210 677-695 | 1731 | CUCCCAGAGGUCUACCCAG | 1755 | CUGGGUAGACCUCUGGGAG |
| NM_001004210 893-911 | 1732 | GAUCACCCUGAAUUCAUUG | 1756 | CAAUGAAUUCAGGGUGAUC |
| NM_001004210 895-913 | 1733 | UCACCCUGAAUUCAUUGUC | 1757 | GACAAUGAAUUCAGGGUGA |
| NM_001004210 1127-1145 | 1734 | CCCCAGCUGAUUAGUGUCU | 1758 | AGACACUAAUCAGCUGGGG |
| NM_001004210 894-912 | 1735 | AUCACCCUGAAUUCAUUGU | 1759 | ACAAUGAAUUCAGGGUGAU |

TABLE 9-continued

Sequences of XBP-1 dsRNAs

| Target* | SEQ ID NO | sense (5'-3') | SEQ ID NO | antisense (5'-3') |
|---|---|---|---|---|
| NM_001004210 1760-1778 | 1736 | CAUUUAUUUAAAACUACCC | 1760 | GGGUAGUUUUAAAUAAAUG |
| NM_001004210 215-233 | 1737 | ACUGAAAACAGAGUAGCA | 1761 | UGCUACUCUGUUUUCAGU |
| NM_001004210 1759-1777 | 1738 | CCAUUUAUUUAAAACUACC | 1762 | GGUAGUUUUAAAUAAAUGG |
| NM_001004210 367-385 | 1739 | UUGAGAACCAGGAGUUAAG | 1763 | CUUAACUCCUGGUUCUCAA |
| NM_001004210 896-914 | 1740 | CACCCUGAAUUCAUUGUCU | 1764 | AGACAAUGAAUUCAGGGUG |
| NM_001004210 214-232 | 1741 | AACUGAAAACAGAGUAGC | 1765 | GCUACUCUGUUUUCAGUU |
| NM_001004210 216-234 | 1742 | CUGAAAACAGAGUAGCAG | 1766 | CUGCUACUCUGUUUUCAG |
| XM_001103095 387-405 | 1743 | AGAAAUCAGCUUUUACGA | 1767 | UCGUAAAAGCUGAUUUCU |
| XM_001103095 1151-1169 | 1744 | UCCCCAGCUGAUUAGUGUC | 1768 | GACACUAAUCAGCUGGGGA |
| XM_001103095 1466-1484 | 1745 | UACUUAUUAUGUAAGGGUC | 1769 | GACCCUUACAUAAUAAGUA |
| XM_001103095 1435-1453 | 1746 | UAUCUUAAAGGGUGGUAG | 1770 | CUACCACCCUUUAAGAUA |
| XM_001103095 577-595 | 1747 | CCAUGGAUUCUGGCGGUAU | 1771 | AUACCGCCAGAAUCCAUGG |
| XM_001103095 790-808 | 1748 | UUAAUGAACUAAUUCGUUU | 1772 | AAACGAAUUAGUUCAUUAA |
| XM_001103095 1479-1497 | 1749 | AGGGUCAUUAGACAAAUGU | 1773 | ACAUUUGUCUAAUGACCCU |
| XM_001103095 794-812 | 1750 | UGAACUAAUUCGUUUUGAC | 1774 | GUCAAAACGAAUUAGUUCA |
| XM_001103095 1150-1108 | 1751 | UUCCCCAGCUGAUUAGUGU | 1775 | ACACUAAUCAGCUGGGGAA |
| XM_001103095 1473-1491 | 1752 | UAUGUAAGGGUCAUUAGAC | 1776 | GUCUAAUGACCCUUACAUA |

*Target refers to target gene and location of target sequence.
NM_001004210 is the gene for rat XBP-1.
XM_001103095 is the sequence for *Macaca mulatta* (rhesus monkey) XBP-1.

TABLE 10

Target gene name and target sequence location for dsRNA targeting XBP-1

| Duplex # | Target gene and location of target sequence |
|---|---|
| AD18027 | NM_001004210_1128-1146 |
| AD18028 | NM_001004210_1129-1147 |
| AD18029 | NM_001004210_677-695 |
| AD18030 | NM_001004210_893-911 |
| AD18031 | NM_001004210_895-913 |
| AD18032 | NM_001004210_1127-1145 |
| AD18033 | NM_001004210_894-912 |
| AD18034 | NM_001004210_1760-1778 |
| AD18035 | NM_001004210_215-233 |
| AD18036 | NM_001004210_1759-1777 |
| AD18037 | NM_001004210_367-385 |
| AD18038 | NM_001004210_896-914 |
| AD18039 | NM_001004210_214-232 |
| AD18040 | NM_001004210_216-234 |
| AD18041 | XM_001103095_387-405 |
| AD18042 | XM_001103095_1151-1169 |
| AD18043 | XM_001103095_1466-1484 |
| AD18044 | XM_001103095_1435-1453 |

TABLE 10-continued

Target gene name and target sequence location for dsRNA targeting XBP-1

| Duplex # | Target gene and location of target sequence |
|---|---|
| AD18045 | XM_001103095_577-595 |
| AD18046 | XM_001103095_790-808 |
| AD18047 | XM_001103095_1479-1497 |
| AD18048 | XM_001103095_794-812 |
| AD18049 | XM_001103095_1150-1168 |
| AD18050 | XM_001103095_1473-1491 |

*Target refers to target gene and location of target sequence. NM_001004210 is the gene for rat XBP-1. XM_001103095 is the sequence for *Macaca mulatta* (rhesus monkey) XBP-1.

TABLE 11

Sequences of dsRNA targeting XBP-1, with Endolight chemistry modifications

| Duplex # | SEQ ID NO | Sense (5'-3') | SEQ ID NO | Antisense (5'-3') |
|---|---|---|---|---|
| AD18027 | 1776 | cccAGcuGAuuAGuGucuAdTsdT | 1800 | uAGAcACuAAUcAGCUGGGdTsdT |
| AD18028 | 1777 | ccAGcuGAuuAGuGucuAAdTsdT | 1801 | UuAGAcACuAAUcAGCUGGGdTsdT |
| AD18029 | 1778 | cucccAGAGGucuAcccAGdTsdT | 1802 | CUGGGuAGACCUCUGGGAGdTsdT |
| AD18030 | 1779 | GAucAcccuGAAuucAuuGdTsdT | 1803 | cAAUGAANUcAGGGUGAUCdTsdT |
| AD18031 | 1780 | ucAcccuGAAuucAuuGucdTsdT | 1804 | GAcAAUGAAUUcAGGGUGAdTsdT |
| AD18032 | 1781 | ccccAGcuGAuuAGuGucudTsdT | 1805 | AGAcACuAAUcAGCUGGGGdTsdT |
| AD18033 | 1782 | AucAcccuGAAuucAuuGudTsdT | 1806 | AcAAUGAAUUcAGGGUGAUdTsdT |
| AD18034 | 1783 | cAuuuAuuuAAAAcuAcccdTsdT | 1807 | GGGuAGUUUuAAAuAAAUGdTsdT |
| AD18035 | 1784 | AcuGAAAAAcAGAGuAGcAdTsdT | 1808 | UGCuACUCUGUUUUUcAGdTsdST |
| AD18036 | 1785 | ccAuuuAuuuAAAAcuAccdTsdT | 1809 | GGuAGUUUuAAAuAAAUGGdTsdT |
| AD18037 | 1786 | uuGAGAAccAGGAGuuAAGdTsdT | 1810 | CUuAACUCCUGGUUCUcAAdTsdT |
| AD18038 | 1787 | cAcccuGAAuucAuuGucudTsdT | 1811 | AGAcAAUGAAUUcAGGGUGdTsdT |
| AD18039 | 1788 | AAcuGAAAAAcAGAGuAGcdTsdT | 1812 | GCuACUCUGUUUUUcAGUUdTsdT |
| AD18040 | 1789 | cuGAAAAAcAGAGuAGcAGdTsdT | 1813 | CUGCuACUCUGUUUUUcAGdTsdT |
| AD18041 | 1790 | AGAAAAucAGcuuuuAcGAdTsdT | 1814 | UCGuAAAAGCUGAUUUUCUdTsdT |
| AD18042 | 1791 | uccccAGcuGAuuAGuGucdTsdT | 1815 | GAcACuAAUcAGCUGGGGAdTsdT |
| AD18043 | 1792 | uAcuuAuuuAuGuAAGGucdTsdT | 1816 | GACCCUuAcAuAAuAAGuAdTsdT |
| AD18044 | 1793 | uAucuuAAAAGGGuGGuAGdTsdT | 1817 | CuACcACCCUUUuAAGAuAdTsdT |
| AD18045 | 1794 | ccAuGGAuucuGGcGGuAudTsdT | 1818 | AuACCGCcAGAAUCcAUGGdTsdT |
| AD18046 | 1795 | uuAAuGAAcuAAuucGuuudTsdT | 1819 | AAACGAAUuAGUUcAUuAAdTsdT |
| AD18047 | 1796 | AGGGucAuuAGAcAAAuGudTsdT | 1820 | AcAUUUGUCuAAUGACCCUdTsdT |
| AD18048 | 1797 | uGAAcuAAuucGuuuuGAcdTsdT | 1821 | GUcAAAACGAAUuAGUUcAdTsdT |
| AD18049 | 1798 | uuccccAGcuGAuuAGuGudTsdT | 1822 | AcACuAAUcAGCUGGGGAAdTsdT |
| AD18050 | 1799 | uAuGuAAGGGucAuuAGAcdTsdT | 1823 | GUCuAAUGACCCUuAcAuAdTsdT |

U, C, A, G: corresponding ribonucleotide; dT: deoxythymidine; u, c, a, g: corresponding 2'-O-methyl ribonucleotide; where nucleotides are written in sequence, they are connected by 3'-5' phosphodiester groups; nucleotides with interjected "s" are connected by 3'-O-5'-O phosphorothiodiester groups.

TABLE 12

Sequences of dsRNA targeting both human and rhesus monkey XBP-1.

| Target* | sense (5'-3') | SEQ ID NO | antisense (5'-3') | SEQ ID NO |
|---|---|---|---|---|
| 100-118 | CUGCUUCUGUCGGGGCAGCNN | 1824 | GCUGCCCCGACAGAAGCAGNN | 2883 |
| 1011-1029 | GAGCUGGGUAUCUCAAAUCNN | 1825 | GAUUUGAGAUACCCAGCUCNN | 2884 |
| 101-119 | UGCUUCUGUCGGGGCAGCCNN | 1826 | GGCUGCCCCGACAGAAGCANN | 2885 |
| 1012-1030 | AGCUGGGUAUCUCAAAUCUNN | 1827 | AGAUUUGAGAUACCCAGCUNN | 2886 |
| 1013-1031 | GCUGGGUAUCUCAAAUCUGNN | 1828 | CAGAUUUGAGAUACCCAGCNN | 2887 |
| 1014-1032 | CUGGGUAUCUCAAAUCUGCNN | 1829 | GCAGAUUUGAGAUACCCAGNN | 2888 |
| 1015-1033 | UGGGUAUCUCAAAUCUGCUNN | 1830 | AGCAGAUUUGAGAUACCCANN | 2889 |
| 1016-1034 | GGGUAUCUCAAAUCUGCUUNN | 1831 | AAGCAGAUUUGAGAUACCCNN | 2890 |
| 1017-1035 | GGUAUCUCAAAUCUGCUUUNN | 1832 | AAAGCAGAUUUGAGAUACCNN | 2891 |
| 1018-1036 | GUAUCUCAAAUCUGCUUUCNN | 1833 | GAAAGCAGAUUUGAGAUACNN | 2892 |
| 1019-1037 | UAUCUCAAAUCUGCUUUCANN | 1834 | UGAAAGCAGAUUUGAGAUANN | 2893 |
| 1020-1038 | AUCUCAAAUCUGCUUUCAUNN | 1835 | AUGAAAGCAGAUUUGAGAUNN | 2894 |
| 1021-1039 | UCUCAAAUCUGCUUUCAUCNN | 1836 | GAUGAAAGCAGAUUUGAGANN | 2895 |
| 102-120 | GCUUCUGUCGGGGCAGCCCNN | 1837 | GGGCUGCCCCGACAGAAGCNN | 2896 |
| 1022-1040 | CUCAAAUCUGCUUUCAUCCNN | 1838 | GGAUGAAAGCAGAUUUGAGNN | 2897 |
| 1023-1041 | UCAAAUCUGCUUUCAUCCANN | 1839 | UGGAUGAAAGCAGAUUUGANN | 2898 |
| 1024-1042 | CAAAUCUGCUUUCAUCCAGNN | 1840 | CUGGAUGAAAGCAGAUUUGNN | 2899 |
| 1025-1043 | AAAUCUGCUUUCAUCCAGCNN | 1841 | GCUGGAUGAAAGCAGAUUUNN | 2900 |
| 1026-1044 | AAUCUGCUUUCAUCCAGCCNN | 1842 | GGCUGGAUGAAAGCAGAUUNN | 2901 |
| 1027-1045 | AUCUGCUUUCAUCCAGCCANN | 1843 | UGGCUGGAUGAAAGCAGAUNN | 2902 |
| 1028-1046 | UCUGCUUUCAUCCAGCCACNN | 1844 | GUGGCUGGAUGAAAGCAGANN | 2903 |
| 1029-1047 | CUGCUUUCAUCCAGCCACUNN | 1845 | AGUGGCUGGAUGAAAGCAGNN | 2904 |
| 1030-1048 | UGCUUUCAUCCAGCCACUGNN | 1846 | CAGUGGCUGGAUGAAAGCANN | 2905 |
| 1031-1049 | GCUUUCAUCCAGCCACUGCNN | 1847 | GCAGUGGCUGGAUGAAAGCNN | 2906 |
| 103-121 | CUUCUGUCGGGGCAGCCCGNN | 1848 | CGGGCUGCCCCGACAGAAGNN | 2907 |
| 1032-1050 | CUUUCAUCCAGCCACUGCCNN | 1849 | GGCAGUGGCUGGAUGAAAGNN | 2908 |
| 1033-1051 | UUUCAUCCAGCCACUGCCCNN | 1850 | GGGCAGUGGCUGGAUGAAANN | 2909 |
| 104-122 | UUCUGUCGGGGCAGCCCGCNN | 1851 | GCGGGCUGCCCCGACAGAANN | 2910 |
| 105-123 | UCUGUCGGGGCAGCCCGCCNN | 1852 | GGCGGGCUGCCCCGACAGANN | 2911 |
| 1056-1074 | CCAUCUUCCUGCCUACUGGNN | 1853 | CCAGUAGGCAGGAAGAUGGNN | 2912 |
| 1057-1075 | CAUCUUCCUGCCUACUGGANN | 1854 | UCCAGUAGGCAGGAAGAUGNN | 2913 |
| 1058-1076 | AUCUUCCUGCCUACUGGAUNN | 1855 | AUCCAGUAGGCAGGAAGAUNN | 2914 |
| 1059-1077 | UCUUCCUGCCUACUGGAUGNN | 1856 | CAUCCAGUAGGCAGGAAGANN | 2915 |
| 1060-1078 | CUUCCUGCCUACUGGAUGCNN | 1857 | GCAUCCAGUAGGCAGGAAGNN | 2916 |
| 1061-1079 | UUCCUGCCUACUGGAUGCUNN | 1858 | AGCAUCCAGUAGGCAGGAANN | 2917 |
| 106-124 | CUGUCGGGGCAGCCCGCCUNN | 1859 | AGGCGGGCUGCCCCGACAGNN | 2918 |
| 1062-1080 | UCCUGCCUACUGGAUGCUUNN | 1860 | AAGCAUCCAGUAGGCAGGANN | 2919 |
| 1063-1081 | CCUGCCUACUGGAUGCUUANN | 1861 | UAAGCAUCCAGUAGGCAGGNN | 2920 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1064-1082 | CUGCCUACUGGAUGCUUACNN | 1862 | GUAAGCAUCCAGUAGGCAGNN | 2921 |
| 1065-1083 | UGCCUACUGGAUGGUUACANN | 1863 | UGNAAGCAUCCAGUAGGCANN | 2922 |
| 1066-1084 | GCCUACUGGAUGCUUACAGNN | 1864 | CUGUAAGCAUCCAGUAGGCNN | 2923 |
| 1067-1085 | CCUACUGGAUGCUUACAGUNN | 1865 | ACUGUAAGCAUCCAGUAGGNN | 2924 |
| 1068-1086 | CUACUGGAUGCUUACAGUGNN | 1866 | CACUGUAAGCAUCCAGUAGNN | 2925 |
| 1069-1087 | UACUGGAUGCUUACAGUGANN | 1867 | UCACUGUAAGCAUCCAGUANN | 2926 |
| 1070-1088 | ACUGGAUGCUUACAGUGACNN | 1868 | GUCACUGUAAGCAUCCAGUNN | 2927 |
| 1071-1089 | CUGGAUGCUUACAGUGACUNN | 1869 | AGUCACUGUAAGCAUCCAGNN | 2928 |
| 107-125 | UGUCGGGGCAGCCCGCCUCNN | 1870 | GAGGCGGGCUGCCCCGACANN | 2929 |
| 1072-1090 | UGGAUGCUUACAGUGACUGNN | 1871 | CAGUCACUGUAAGCAUCCANN | 2930 |
| 1073-1091 | GGAUGCUUACAGUGACUGUNN | 1872 | ACAGUCACUGUAAGCAUCCNN | 2931 |
| 1074-1092 | GAUGCUUACAGUGACUGUGNN | 1873 | CACAGUCACUGUAAGCAUCNN | 2932 |
| 1075-1093 | AUGCUUACAGUGACUGUGGNN | 1874 | CCACAGUCACUGUAAGCAUNN | 2933 |
| 1076-1094 | UGCUUACAGUGACUGUGGANN | 1875 | UCCACAGUCACUGUAAGCANN | 2934 |
| 1077-1095 | GCUUACAGUGACUGUGGAUNN | 1876 | AUCCACAGUCACUGUAAGCNN | 2935 |
| 1078-1096 | CUUACAGUGACUGUGGAUANN | 1877 | UAUCCACAGUCACUGUAAGNN | 2936 |
| 108-126 | GUCGGGGCAGCCCGCCUCCNN | 1878 | GGAGGCGGGCUGCCCCGACNN | 2937 |
| 109-127 | UCGGGGCAGCCCGCCUCCGNN | 1879 | CGGAGGCGGGCUGCCCCGANN | 2938 |
| 110-128 | CGGGGCAGCCCGCCUCCGCNN | 1880 | GCGGAGGCGGGCUGCCCCGNN | 2939 |
| 111-129 | GGGGCAGCCCGCCUCCGCCNN | 1881 | GGCGGAGGCGGGCUGCCCCNN | 2940 |
| 1116-1134 | UUCAGUGACAUGUCCUCUCNN | 1882 | GAGAGGACAUGUCACUGAANN | 2941 |
| 112-130 | GGGCAGCCCGCCUCCGCCGNN | 1883 | CGGCGGAGGCGGGCUGCCCNN | 2942 |
| 113-131 | GGCAGCCCGCCUCCGCCGCNN | 1884 | GCGGCGGAGGCGGGCUGCCNN | 2943 |
| 1136-1154 | GCUUGGUGUAAACCAUUCUNN | 1885 | AGAAUGGUUUACACCAAGCNN | 2944 |
| 1137-1155 | CUUGGUGUAAACCAUUCUUNN | 1886 | AAGAAUGGUUUACACCAAGNN | 2945 |
| 1138-1156 | UUGGUGUAAACCAUUCUUGNN | 1887 | CAAGAAUGGUUUACACCAANN | 2946 |
| 1139-1157 | UGGUGUAAACCAUUCUUGGNN | 1888 | CCAAGAAUGGUUUACACCANN | 2947 |
| 1140-1158 | GGUGUAAACCAUUCUUGGGNN | 1889 | CCCAAGAAUGGUUUACACCNN | 2948 |
| 1141-1159 | GUGUAAACCAUUCUUGGGANN | 1890 | UCCCAAGAAUGGUUUACACNN | 2949 |
| 114-132 | GCAGCCCGCCUCCGCCGCCNN | 1891 | GGCGGCGGAGGCGGGCUGCNN | 2950 |
| 1142-1160 | UGUAAACCAUUCUUGGGAGNN | 1892 | CUCCCAAGAAUGGUUUACANN | 2951 |
| 1143-1161 | GUAAACCAUUCUUGGGAGGNN | 1893 | CCUCCCAAGAAUGGUUUACNN | 2952 |
| 1144-1162 | UAAACCAUUCUUGGGAGGANN | 1894 | UCCUCCCAAGAAUGGUUUANN | 2953 |
| 1145-1163 | AAACCAUUCUUGGGAGGACNN | 1895 | GUCCUCCCAAGAAUGGUUUNN | 2954 |
| 1146-1164 | AACCAUUCUUGGGAGGACANN | 1896 | UGUCCUCCCAAGAAUGGUUNN | 2955 |
| 1147-1165 | ACCAUUCUUGGGAGGACACNN | 1897 | GUGUCCUCCCAAGAAUGGUNN | 2956 |
| 1148-1166 | CCAUUCUUGGGAGGACACUNN | 1898 | AGUGUCCUCCCAAGAAUGGNN | 2957 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1149-1167 | CAUUCUUGGGAGGACACUUNN | 1899 | AAGUGUCCUCCCAAGAAUGNN | 2958 |
| 1150-1168 | AUUCUUGGGAGGACACUUUNN | 1900 | AAAGUGUCCUCCCAAGAAUNN | 2959 |
| 1151-1169 | UUCUUGGGAGGACACUUUUNN | 1901 | AAAAGUGUCCUCCCAAGAANN | 2960 |
| 115-133 | CAGCCCGCCUCCGCCGCCGNN | 1902 | CGGCGGCGGAGGCGGGCUGNN | 2961 |
| 1152-1170 | UCUUGGGAGGACACUUUUGNN | 1903 | CAAAAGUGUCCUCCCAAGANN | 2962 |
| 1153-1171 | CUUGGGAGGACACUUUUGCNN | 1904 | GCAAAAGUGUCCUCCCAAGNN | 2963 |
| 1154-1172 | UUGGGAGGACACUUUUGCCNN | 1905 | GGCAAAAGUGUCCUCCCAANN | 2964 |
| 1155-1173 | UGGGAGGACACUUUUGCCANN | 1906 | UGGCAAAAGUGUCCUCCCANN | 2965 |
| 1156-1174 | GGGAGGACACUUUUGCCAANN | 1907 | UUGGCAAAAGUGUCCUCCCNN | 2966 |
| 1157-1175 | GGAGGACACUUUUGCCAAUNN | 1908 | AUUGGCAAAAGUGUCCUCCNN | 2967 |
| 1158-1176 | GAGGACACUUUUGCCAAUGNN | 1909 | CAUUGGCAAAAGUGUCCUCNN | 2968 |
| 1159-1177 | AGGACACUUUUGCCAAUGANN | 1910 | UCAUUGGCAAAAGUGUCCUNN | 2969 |
| 1160-1178 | GGACACUUUUGCCAAUGAANN | 1911 | UUCAUUGGCAAAAGUGUCCNN | 2970 |
| 1161-1179 | GACACUUUUGCCAAUGAACNN | 1912 | GUUCAUUGGCAAAAGUGUCNN | 2971 |
| 116-134 | AGCCCGCCUCCGCCGCCGGNN | 1913 | CCGGCGGCGGAGGCGGGCUNN | 2972 |
| 1162-1180 | ACACUUUUGCCAAUGAACUNN | 1914 | AGUUCAUUGGCAAAAGUGUNN | 2973 |
| 117-135 | GCCCGCCUCCGCCGCCGGANN | 1915 | UCCGGCGGCGGAGGCGGGCNN | 2974 |
| 118-136 | CCCGCCUCCGCCGCCGGAGNN | 1916 | CUCCGGCGGCGGAGGCGGGNN | 2975 |
| 1182-1200 | UUUCCCAGCUGAUUAGUGNN | 1917 | CACUAAUCAGCUGGGGAAANN | 2976 |
| 1183-1201 | UUCCCCAGCUGAUUAGUGUNN | 1918 | ACACUAAUCAGCUGGGGAANN | 2977 |
| 1184-1202 | UCCCCAGCUGAUUAGUGUCNN | 1919 | GACACUAAUCAGCUGGGGANN | 2978 |
| 1185-1203 | CCCCAGCUGAUUAGUGUCUNN | 1920 | AGACACUAAUCAGCUGGGGNN | 2979 |
| 1186-1204 | CCCAGCUGAUUAGUGUCUANN | 1921 | UAGACACUAAUCAGCUGGGNN | 2980 |
| 1187-1205 | CCAGCUGAUUAGUGUCUAANN | 1922 | UUAGACACUAAUCAGCUGGNN | 2981 |
| 1188-1206 | CAGCUGAUUAGUGUCUAAGNN | 1923 | CUUAGACACUAAUCAGCUGNN | 2982 |
| 1189-1207 | AGCUGAUUAGUGUCUAAGGNN | 1924 | CCUUAGACACUAAUCAGCUNN | 2983 |
| 1190-1208 | GCUGAUUAGUGUCUAAGGANN | 1925 | UCCUUAGACACUAAUCAGCNN | 2984 |
| 1191-1209 | CUGAUUAGUGUCUAAGGAANN | 1926 | UUCCUUAGACACUAAUCAGNN | 2985 |
| 119-137 | CCGCCUCCGCCGCCGGAGCNN | 1927 | GCUCCGGCGGCGGAGGCGGNN | 2986 |
| 1192-1210 | UGAUUAGUGUCUAAGGAAUNN | 1928 | AUUCCUUAGACACUAAUCANN | 2987 |
| 1193-1211 | GAUUAGUGUCUAAGGAAUGNN | 1929 | CAUUCCUUAGACACUAAUCNN | 2988 |
| 1194-1212 | AUUAGUGUCUAAGGAAUGANN | 1930 | UCAUUCCUUAGACACUAAUNN | 2989 |
| 1195-1213 | UUAGUGUCUAAGGAAUGAUNN | 1931 | AUCAUUCCUUAGACACUAANN | 2990 |
| 1196-1214 | UAGUGUCUAAGGAAUGAUCNN | 1932 | GAUCAUUCCUUAGACACUANN | 2991 |
| 1197-1215 | AGUGUCUAAGGAAUGAUCCNN | 1933 | GGAUCAUUCCUUAGACACUNN | 2992 |
| 1198-1216 | GUGUCUAAGGAAUGAUCCANN | 1934 | UGGAUCAUUCCUUAGACACNN | 2993 |
| 120-138 | CGCCUCCGCCGCCGGAGCCNN | 1935 | GGCUCCGGCGGCGGAGGCGNN | 2994 |
| 121-139 | GCCUCCGCCGCCGGAGCCCNN | 1936 | GGGCUCCGGCGGCGGAGGCNN | 2995 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1218-1236 | UACUGUUGCCCUUUUCCUUNN | 1937 | AAGGAAAAGGGCAACAGUANN | 2996 |
| 1219-1237 | ACUGUUGCCCUUUUCCUUGNN | 1938 | CAAGGAAAAGGGCAACAGUNN | 2997 |
| 1220-1238 | CUGUUGCCCUUUUCCUUGANN | 1939 | UCAAGGAAAAGGGCAACAGNN | 2998 |
| 1221-1239 | UGUUGCCCUUUUCCUUGACNN | 1940 | GUCAAGGAAAAGGGCAACANN | 2999 |
| 122-140 | CCUCCGCCGCCGGAGCCCCNN | 1941 | GGGGCUCCGGCGGCGGAGGNN | 3000 |
| 1222-1240 | GUUGCCCUUUUCCUUGACUNN | 1942 | AGUCAAGGAAAAGGGCAACNN | 3001 |
| 1223-1241 | UUGCCCUUUUCCUUGACUANN | 1943 | UAGUCAAGGAAAAGGGCAANN | 3002 |
| 1224-1242 | UGCCCUUUUCCUUGACUAUNN | 1944 | AUAGUCAAGGAAAAGGGCANN | 3003 |
| 1225-1243 | GCCCUUUUCCUUGACUAUUNN | 1945 | AAUAGUCAAGGAAAAGGGCNN | 3004 |
| 1226-1244 | CCCUUUUCCUUGACUAUUANN | 1946 | UAAUAGUCAAGGAAAAGGGNN | 3005 |
| 1227-1245 | CCUUUUCCUUGACUAUUACNN | 1947 | GUAAUAGUCAAGGAAAAGGNN | 3006 |
| 1228-1246 | CUUUUCCUUGACUAUUACANN | 1948 | UGUAAUAGUCAAGGAAAAGNN | 3007 |
| 1229-1247 | UUUUCCUUGACUAUUACACNN | 1949 | GUGUAAUAGUCAAGGAAAANN | 3008 |
| 1230-1248 | UUUCCUUGACUAUUACACUNN | 1950 | AGUGUAAUAGUCAAGGAAANN | 3009 |
| 1231-1249 | UUCCUUGACUAUUACACUGNN | 1951 | CAGUGUAAUAGUCAAGGAANN | 3010 |
| 123-141 | CUCCGCCGCCGGAGCCCCGNN | 1952 | CGGGGCUCCGGCGGCGGAGNN | 3011 |
| 1232-1250 | UCCUUGACUAUUACACUGCNN | 1953 | GCAGUGUAAUAGUCAAGGANN | 3012 |
| 1233-1251 | CCUUGACUAUUACACUGCCNN | 1954 | GGCAGUGUAAUAGUCAAGGNN | 3013 |
| 1234-1252 | CUUGACUAUUACACUGCCUNN | 1955 | AGGCAGUGUAAUAGUCAAGNN | 3014 |
| 1235-1253 | UUGACUAUUACACUGCCUGNN | 1956 | CAGGCAGUGUAAUAGUCAANN | 3015 |
| 1236-1254 | UGACUAUUACACUGCCUGGNN | 1957 | CCAGGCAGUGUAAUAGUCANN | 3016 |
| 1237-1255 | GACUAUUACACUGCCUGGANN | 1958 | UCCAGGCAGUGUAAUAGUCNN | 3017 |
| 1238-1256 | ACUAUUACACUGCCUGGAGNN | 1959 | CUCCAGGCAGUGUAAUAGUNN | 3018 |
| 1239-1257 | CUAUUACACUGCCUGGAGGNN | 1960 | CCUCCAGGCAGUGUAAUAGNN | 3019 |
| 1240-1258 | UAUUACACUGCCUGGAGGANN | 1961 | UCCUCCAGGCAGUGUAAUANN | 3020 |
| 1241-1259 | AUUACACUGCCUGGAGGAUNN | 1962 | AUCCUCCAGGCAGUGUAAUNN | 3021 |
| 124-142 | UCCGCCGCCGGAGCCCCGGNN | 1963 | CCGGGGCUCCGGCGGCGGANN | 3022 |
| 1242-1260 | UUACACUGCCUGGAGGAUANN | 1964 | UAUCCUCCAGGCAGUGUAANN | 3023 |
| 1243-1261 | UACACUGCCUGGAGGAUAGNN | 1965 | CUAUCCUCCAGGCAGUGUANN | 3024 |
| 1244-1262 | ACACUGCCUGGAGGAUAGCNN | 1966 | GCUAUCCUCCAGGCAGUGUNN | 3025 |
| 1245-1263 | CACUGCCUGGAGGAUAGCANN | 1967 | UGCUAUCCUCCAGGCAGUGNN | 3026 |
| 1246-1264 | ACUGCCUGGAGGAUAGCAGNN | 1968 | CUGCUAUCCUCCAGGCAGUNN | 3027 |
| 125-143 | CCGCCGCCGGAGCCCCGGCNN | 1969 | GCCGGGGCUCCGGCGGCGGNN | 3028 |
| 126-144 | CGCCGCCGGAGCCCCGGCCNN | 1970 | GGCCGGGGCUCCGGCGGCGNN | 3029 |
| 127-145 | GCCGCCGGAGCCCCGGCCGNN | 1971 | CGGCCGGGGCUCCGGCGGCNN | 3030 |
| 1280-1298 | CUUCAUUCAAAAAGCCAAANN | 1972 | UUUGGCUUUUUGAAUGAAGNN | 3031 |
| 1281-1299 | UUCAUUCAAAAAGCCAAAUNN | 1973 | UUUUGGCUUUUUGAAUGAANN | 3032 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 128-146 | CCGCCGGAGCCCCGGCCGGNN | 1974 | CCGGCCGGGGCUCCGGCGGNN | 3033 |
| 1282-1300 | UCAUUCAAAAAGCCAAAAUNN | 1975 | AUUUUGGCUUUUUGAAUGANN | 3034 |
| 1283-1301 | CAUUCAAAAAGCCAAAAUANN | 1976 | UAUUUUGGCUUUUUGAAUGNN | 3035 |
| 1284-1302 | AUUCAAAAAGCCAAAAUAGNN | 1977 | CUAUUUUGGCUUUUUGAAUNN | 3036 |
| 1285-1303 | UUCAAAAAGCCAAAAUAGANN | 1978 | UCUAUUUUGGCUUUUUGAANN | 3037 |
| 1286-1304 | UCAAAAAGCCAAAAUAGAGNN | 1979 | CUCUAUUUUGGCUUUUUGANN | 3038 |
| 1287-1305 | CAAAAAGCCAAAAUAGAGANN | 1980 | UCUCUAUUUUGGCUUUUUGNN | 3039 |
| 1288-1306 | AAAAAGCCAAAAUAGAGAGNN | 1981 | CUCUCUAUUUUGGCUUUUUNN | 3040 |
| 1289-1307 | AAAAGCCAAAAUAGAGAGUNN | 1982 | ACUCUCUAUUUUGGCUUUUNN | 3041 |
| 1290-1308 | AAAGCCAAAAUAGAGAGUANN | 1983 | UACUCUCUAUUUUGGCUUUNN | 3042 |
| 129-147 | CGCCGGAGCCCCGGCCGGCNN | 1984 | GCCGGCCGGGGCUCCGGCGNN | 3043 |
| 130-148 | GCCGGAGCCCCGGCCGGCCNN | 1985 | GGCCGGCCGGGGCUCCGGNN | 3044 |
| 1310-1328 | ACAGUCCUAGAGAAUUCCUNN | 1986 | AGGAAUUCUCUAGGACUGUNN | 3045 |
| 131-149 | CCGGAGCCCCGGCCGGCCANN | 1987 | TGGCCGGCCGGGGCUCCGGNN | 3046 |
| 132-150 | CGGAGCCCCGGCCGGCCAGNN | 1988 | CTGGCCGGCCGGGGCUCCGNN | 3047 |
| 1330-1348 | UAUUUGUUCAGAUCUCAUANN | 1989 | UAUGAGAUCUGAACAAAUANN | 3048 |
| 1331-1349 | AUUUGUUCAGAUCUCAUAGNN | 1990 | CUAUGAGAUCUGAACAAAUNN | 3049 |
| 133-151 | GGAGCCCCGGCCGGCCAGGNN | 1991 | CCTGGCCGGCCGGGGCUCCNN | 3050 |
| 1332-1350 | UUUGUUCAGAUCUCAUAGANN | 1992 | UCUAUGAGAUCUGAACAAANN | 3051 |
| 1333-1351 | UUGUUCAGAUCUCAUAGAUNN | 1993 | AUCUAUGAGAUCUGAACAANN | 3052 |
| 1334-1352 | UGUUCAGAUCUCAUAGAUGNN | 1994 | CAUCUAUGAGAUCUGAACANN | 3053 |
| 1335-1353 | GUUCAGAUCUCAUAGAUGANN | 1995 | UCAUCUAUGAGAUCUGAACNN | 3054 |
| 134-152 | GAGCCCCGGCCGGCCAGGCNN | 1996 | GCCTGGCCGGCCGGGGCUCNN | 3055 |
| 135-153 | AGCCCCGGCCGGCCAGGCCNN | 1997 | GGCCTGGCCGGCCGGGGCUNN | 3056 |
| 136-154 | GCCCCGGCCGGCCAGGCCCNN | 1998 | GGGCCTGGCCGGCCGGGGCNN | 3057 |
| 1365-1383 | UGUCUUUUGACAUCCAGCANN | 1999 | UGCUGGAUGUCAAAAGACNN | 3058 |
| 1366-1384 | GUCUUUUGACAUCCAGCAGNN | 2000 | CUGCUGGAUGUCAAAAGACNN | 3059 |
| 1367-1385 | UCUUUUGACAUCCAGCAGUNN | 2001 | ACUGCUGGAUGUCAAAAGANN | 3060 |
| 1368-1386 | CUUUUGACAUCCAGCAGUCNN | 2002 | GACUGCUGGAUGUCAAAAGNN | 3061 |
| 1369-1387 | UUUUGACAUCCAGCAGUCCNN | 2003 | GGACUGCUGGAUGUCAAAANN | 3062 |
| 1370-1388 | UUUGACAUCCAGCAGUCCANN | 2004 | UGGACUGCUGGAUGUCAAANN | 3063 |
| 1371-1389 | UUGACAUCCAGCAGUCCAANN | 2005 | UUGGACUGCUGGAUGUCAANN | 3064 |
| 137-155 | CCCCGGCCGGCCAGGCCCUNN | 2006 | AGGGCCUGGCCGGCCGGGGNN | 3065 |
| 138-156 | CCCGGCCGGCCAGGCCCUGNN | 2007 | CAGGGCCUGGCCGGCCGGGNN | 3066 |
| 1391-1409 | GUAUUGAGACAUAUUACUGNN | 2008 | CAGUAAUAUGUCUCAAUACNN | 3067 |
| 139-157 | CCGGCCGGCCAGGCCCUGCNN | 2009 | GCAGGGCCUGGCCGGCCGGNN | 3068 |
| 140-158 | CGGCCGGCCAGGCCCUGCCNN | 2210 | GGCAGGGCCUGGCCGGCCGNN | 3069 |
| 141-159 | GGCCGGCCAGGCCCUGCCGNN | 2011 | CGGCAGGGCCUGGCCGGCCNN | 3070 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1414-1432 | UAAGAAAUAUUACUAUAAUNN | 2012 | AUUAUAGUAAUAUUUCUUANN | 3071 |
| 1415-1433 | AAGAAAUAUUACUAUAAUUNN | 2013 | AAUUAUAGUAAUAUUUCUUNN | 3072 |
| 1461-1434 | AGAAAUAUUACUAUAAUUGNN | 2014 | CAAUUAUAGUAAUAUUUCUNN | 3073 |
| 1417-1435 | GAAAUAUUACUAUAAUUGANN | 2015 | UCAAUUAUAGUAAUAUUUCNN | 3074 |
| 1418-1436 | AAAUAUUACUAUAAUUGAGNN | 2016 | CUCAAUUAUAGUAAUAUUUNN | 3075 |
| 1419-1437 | AAUAUUACUAUAAUUGAGANN | 2017 | UCUCAAUUAUAGUAAUAUUNN | 3076 |
| 1420-1438 | AUAUUACUAUAAUUGAGAANN | 2018 | UUCUCAAUUAUAGUAAUAUNN | 3077 |
| 1421-1439 | UAUUACUAUAAUUGAGAACNN | 2019 | GUUCUCAAUUAUAGUAAUANN | 3078 |
| 142-160 | GCCGGCCAGGCCCUGCCGCNN | 2020 | GCGGCAGGGCCUGGCCGGCNN | 3079 |
| 1422-1440 | AUUACUAUAAUUGAGAACUNN | 2021 | AGUUCUCAAUUAUAGUAAUNN | 3080 |
| 1423-1441 | UUACUAUAAUUGAGAACUANN | 2022 | UAGUUCUCAAUUAUAGUAANN | 3081 |
| 1424-1442 | UACUAUAAUUGAGAACUACNN | 2023 | GUAGUUCUCAAUUAUAGUANN | 3082 |
| 1425-1443 | ACUAUAAUUGAGAACUACANN | 2024 | UGUAGUUCUCAAUUAUAGUNN | 3083 |
| 1426-1444 | CUAUAAUUGAGAACUACAGNN | 2025 | CUGUAGUUCUCAAUUAUAGNN | 3084 |
| 1427-1445 | UAUAAUUGAGAACUACAGCNN | 2026 | GCUGUAGUUCUCAAUUAUANN | 3085 |
| 1428-1446 | AUAAUUGAGAACUACAGCUNN | 2027 | AGCUGUAGUUCUCAAUUAUNN | 3086 |
| 1429-1447 | UAAUUGAGAACUACAGCUUNN | 2028 | AAGCUGUAGUUCUCAAUUANN | 3087 |
| 1430-1448 | AAUUGAGAACUACAGCUUUNN | 2029 | AAAGCUGUAGUUCUCAAUUNN | 3088 |
| 1431-1449 | AUUGAGAACUACAGCUUUUNN | 2030 | AAAAGCUGUAGUUCUCAAUNN | 3089 |
| 143-161 | CCGGCCAGGCCCUGCCGCUNN | 2031 | AGCGGCAGGGCCUGGCCGGNN | 3090 |
| 1432-1450 | UUGAGAACUACAGCUUUUANN | 2032 | UAAAAGCUGUAGUUCUCAANN | 3091 |
| 1433-1451 | UGAGAACUACAGCUUUUAANN | 2033 | UUAAAAGCUGUAGUUCUCANN | 3092 |
| 1434-1452 | GAGAACUACAGCUUUUAAGNN | 2034 | CUUAAAAGCUGUAGUUCUCNN | 3093 |
| 1435-1453 | AGAACUACAGCUUUUAAGANN | 2035 | UCUUAAAAGCUGUAGUUCUNN | 3094 |
| 1436-1454 | GAACUACAGCUUUUAAGAUNN | 2036 | AUCUUAAAAGCUGUAGUUCNN | 3095 |
| 1437-1455 | AACUACAGCUUUUAAGAUUNN | 2037 | AAUCUUAAAAGCUGUAGUUNN | 3096 |
| 1438-1456 | ACUACAGCUUUUAAGAUUGNN | 2038 | CAAUCUUAAAAGCUGUAGUNN | 3097 |
| 1439-1457 | CUACAGCUUUUAAGAUUGUNN | 2039 | ACAAUCUUAAAAGCUGUAGNN | 3098 |
| 1440-1458 | UACAGCUUUUAAGAUUGUANN | 2040 | UACAAUCUUAAAAGCUGUANN | 3099 |
| 1441-1459 | ACAGCUUUUAAGAUUGUACNN | 2041 | GUACAAUCUUAAAAGCUGUNN | 3100 |
| 144-162 | CGGCCAGGCCCUGCCGCUCNN | 2042 | GAGCGGCAGGGCCUGGCCGNN | 3101 |
| 1442-1460 | CAGCUUUUAAGAUUGUACUNN | 2043 | AGUACAAUCUUAAAAGCUGNN | 3102 |
| 1443-1461 | AGCUUUUAAGAUUGUACUUNN | 2044 | AAGUACAAUCUUAAAAGCUNN | 3103 |
| 1444-1462 | GCUUUUAAGAUUGUACUUUNN | 2045 | AAAGUACAAUCUUAAAAGCNN | 3104 |
| 1445-1463 | CUUUUAAGAUUGUACUUUUNN | 2046 | AAAAGUACAAUCUUAAAAGNN | 3105 |
| 1446-1464 | UUUUAAGAUUGUACUUUUANN | 2047 | UAAAAGUACAAUCUUAAAANN | 3106 |
| 1447-1465 | UUUAAGAUUGUACUUUUAUNN | 2048 | AUAAAAGUACAAUCUUAAANN | 3107 |

TABLE 12 -continued

Sequences of dsRNA targeting both human and rhesus monkeyXBP-1.

| Target* | sense (5'-3') | SEQ ID NO | antisense (5'-3') | SEQ ID NO |
|---|---|---|---|---|
| 1448-1466 | UUAAGAUUGUACUUUUAUCNN | 2049 | GAUAAAAGUACAAUCUUAANN | 3108 |
| 1449-1467 | UAAGAUUGUACUUUUAUCUNN | 2050 | AGAUAAAAGUACAAUCUUANN | 3109 |
| 1450-1468 | AAGAUUGUACUUUUAUCUUNN | 2051 | AAGAUAAAAGUACAAUCUUNN | 3110 |
| 1451-1469 | AGAUUGUACUUUUAUCUUANN | 2052 | UAAGAUAAAAGUACAAUCUNN | 3111 |
| 145-163 | GGCCAGGCCCUGCCGCUCANN | 2053 | UGAGCGGCAGGGCCUGGCCNN | 3112 |
| 1452-1470 | GAUUGUACUUUUAUCUUAANN | 2054 | UUAAGAUAAAAGUACAAUCNN | 3113 |
| 1453-1471 | AUUGUACUUUUAUCUUAAANN | 2055 | UUUAAGAUAAAAGUACAAUNN | 3114 |
| 1454-1472 | UUGUACUUUUAUCUUAAAANN | 2056 | UUUUAAGAUAAAAGUACAANN | 3115 |
| 1455-1473 | UGUACUUUUAUCUUAAAAGNN | 2057 | CUUUUAAGAUAAAAGUACANN | 3116 |
| 1456-1474 | GUACUUUUAUCUUAAAAGGNN | 2058 | CCUUUUAAGAUAAAAGUACNN | 3117 |
| 1457-1475 | UACUUUUAUCUUAAAAGGGNN | 2059 | CCCUUUUAAGAUAAAAGUANN | 3118 |
| 1458-1476 | ACUUUUAUCUUAAAAGGGUNN | 2060 | ACCCUUUUAAGAUAAAAGUNN | 3119 |
| 1459-1477 | CUUUUAUCUUAAAAGGGUGNN | 2061 | CACCCUUUUAAGAUAAAAGNN | 3120 |
| 1460-1478 | UUUUAUCUUAAAAGGGUGGNN | 2062 | CCACCCUUUUAAGAUAAAANN | 3121 |
| 1461-1479 | UUUAUCUUAAAAGGGUGGUNN | 2063 | ACCACCCUUUUAAGAUAAANN | 3122 |
| 146-164 | GCCAGGCCCUGCCGCUCAUNN | 2064 | AUGAGCGGCAGGGCCUGGCNN | 3123 |
| 1462-1480 | UUAUCUUAAAAGGGUGGUANN | 2065 | UACCACCCUUUUAAGAUAANN | 3124 |
| 1463-1481 | UAUCUUAAAAGGGUGGUAGNN | 2066 | CUACCACCCUUUUAAGAUANN | 3125 |
| 1464-1482 | AUCUUAAAAGGGUGGUAGUNN | 2067 | ACUACCACCCUUUUAAGAUNN | 3126 |
| 1465-1483 | UCUUAAAAGGGUGGUAGUUNN | 2068 | AACUACCACCCUUUUAAGANN | 3127 |
| 1466-1484 | CUUAAAAGGGUGGUAGUUUNN | 2069 | AAACUACCACCCUUUUAAGNN | 3128 |
| 147-165 | CCAGGCCCUGCCGCUCAUGNN | 2070 | CAUGAGCGGCAGGGCCUGGNN | 3129 |
| 148-166 | CAGGCCCUGCCGCUCAUGGNN | 2071 | CCAUGAGCGGCAGGGCCUGNN | 3130 |
| 1486-1504 | CCCUAAAAUACUUAUUAUGNN | 2072 | CAUAAUAAGUAUUUUAGGGNN | 3131 |
| 1487-1505 | CCUAAAAUACUUAUUAUGUNN | 2073 | ACAUAAUAAGUAUUUUAGGNN | 3132 |
| 1488-1506 | CUAAAAUACUUAUUAUGUANN | 2074 | UACAUAAUAAGUAUUUUAGNN | 3133 |
| 1489-1507 | UAAAAUACUUAUUAUGUAANN | 2075 | UUACAUAAUAAGUAUUUUANN | 3134 |
| 1490-1508 | AAAAUACUUAUUAUGUAAGNN | 2076 | CUUACAUAAUAAGUAUUUUNN | 3135 |
| 1491-1509 | AAAUACUUAUUAUGUAAGGNN | 2077 | CCUUACAUAAUAAGUAUUUNN | 3136 |
| 149-167 | AGGCCCUGCCGCUCAUGGUNN | 2078 | ACCAUGAGCGGCAGGGCCUNN | 3137 |
| 1492-1510 | AAUACUUAUUAUGUAAGGGNN | 2079 | CCCUUACAUAAUAAGUAUUNN | 3138 |
| 1493-1511 | AUACUUAUUAUGUAAGGGUNN | 2080 | ACCCUUACAUAAUAAGUAUNN | 3139 |
| 1494-1512 | UACUUAUUAUGUAAGGGUCNN | 2081 | GACCCUUACAUAAUAAGUANN | 3140 |
| 1495-1513 | ACUUAUUAUGUAAGGGUCANN | 2082 | UGACCCUUACAUAAUAAGUNN | 3141 |
| 1496-1514 | CUUAUUAUGUAAGGGUCAUNN | 2083 | AUGACCCUUACAUAAUAAGNN | 3142 |
| 1497-1515 | UUAUUAUGUAAGGGUCAUUNN | 2084 | AAUGACCCUUACAUAAUAANN | 3143 |
| 1498-1516 | UAUUAUGUAAGGGUCAUUANN | 2085 | UAAUGACCCUUACAUAAUANN | 3144 |
| 1499-1517 | AUUAUGUAAGGGUCAUUAGNN | 2086 | CUAAUGACCCUUACAUAAUNN | 3145 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1500-1518 | UUAUGUAAGGGUCAUUAGANN | 2087 | UCUAAUGACCCUUACAUAANN | 3146 |
| 1501-1519 | UAUGUAAGGGUCAUUAGACNN | 2088 | GUCUAAUGACCCUUACAUANN | 3147 |
| 150-168 | GGCCCUGCCGCUCAUGGUGNN | 2089 | CACCAUGAGCGGCAGGGCCNN | 3148 |
| 1502-1520 | AUGUAAGGGUCAUUAGACANN | 2090 | UGUCUAAUGACCCUUACAUNN | 3149 |
| 1503-1521 | UGUAAGGGUCAUUAGACAANN | 2091 | UUGUCUAAUGACCCUUACANN | 3150 |
| 1504-1522 | GUAAGGGUCAUUAGACAAANN | 2092 | UUUGUCUAAUGACCCUUACNN | 3151 |
| 1505-1523 | UAAGGGUCAUUAGACAAAUNN | 2093 | AUUUGUCUAAUGACCCUUANN | 3152 |
| 1506-1524 | AAGGGUCAUUAGACAAAUGNN | 2094 | CAUUUGUCUAAUGACCCUUNN | 3153 |
| 1507-1525 | AGGGUCAUUAGACAAAUGUNN | 2095 | ACAUUUGUCUAAUGACCCUNN | 3154 |
| 1508-1526 | GGGUCAUUAGACAAAUGUCNN | 2096 | GACAUUUGUCUAAUGACCCNN | 3155 |
| 1509-1527 | GGUCAUUAGACAAAUGUCUNN | 2097 | AGACAUUUGUCUAAUGACCNN | 3156 |
| 1510-1528 | GUCAUUAGACAAAUGUCUUNN | 2098 | AAGACAUUUGUCUAAUGACNN | 3157 |
| 1511-1529 | UCAUUAGACAAAUGUCUUGNN | 2099 | CAAGACAUUUGUCUAAUGANN | 3158 |
| 151-169 | GCCCUGCCGCUCAUGGUGCNN | 2100 | GCACCAUGAGCGGCAGGGCNN | 3159 |
| 1512-1530 | CAUUAGACAAAUGUCUUGANN | 2101 | UCAAGACAUUUGUCUAAUGNN | 3160 |
| 1513-1531 | AUUAGACAAAUGUCUUGAANN | 2102 | UUCAAGACAUUUGUCUAAUNN | 3161 |
| 1514-1532 | UUAGACAAAUGUCUUGAAGNN | 2103 | CUUCAAGACAUUUGUCUAANN | 3162 |
| 1515-1533 | UAGACAAAUGUCUUGAAGUNN | 2104 | ACUUCAAGACAUUUGUCUANN | 3163 |
| 1516-1534 | AGACAAAUGUCUUGAAGUANN | 2105 | UACUUCAAGACAUUUGUCUNN | 3164 |
| 1517-1535 | GACAAAUGUCUUGAAGUAGNN | 2106 | CUACUUCAAGACAUUUGUCNN | 3165 |
| 1518-1536 | ACAAAUGUCUUGAAGUAGANN | 2107 | UCUACUUCAAGACAUUUGUNN | 3166 |
| 152-170 | CCCUGCCGCUCAUGGUGCCNN | 2108 | GGCACCAUGAGCGGCAGGGNN | 3167 |
| 153-171 | CCUGCCGCUCAUGGUGCCANN | 2109 | UGGCACCAUGAGCGGCAGGNN | 3168 |
| 1541-1559 | GAAUUUAUGAAUGGUUCUUNN | 2110 | AAGAACCAUUCAUAAAUUCNN | 3169 |
| 154-172 | CUGCCGCUCAUGGUGCCAGNN | 2111 | CUGGCACCAUGAGCGGCAGNN | 3170 |
| 1542-1560 | AAUUUAUGAAUGGUUCUUUNN | 2112 | AAAGAACCAUUCAUAAAUUNN | 3171 |
| 1543-1561 | AUUUAUGAAUGGUUCUUUANN | 2113 | UAAAGAACCAUUCAUAAAUNN | 3172 |
| 1544-1562 | UUUAUGAAUGGUUCUUUAUNN | 2114 | AUAAAGAACCAUUCAUAAANN | 3173 |
| 1545-1563 | UUAUGAAUGGUUCUUUAUCNN | 2115 | GAUAAAGAACCAUUCAUAANN | 3174 |
| 1546-1564 | UAUGAAUGGUUCUUUAUCANN | 2116 | UGAUAAAGAACCAUUCAUANN | 3175 |
| 1547-1565 | AUGAAUGGUUCUUUAUCAUNN | 2117 | AUGAUAAAGAACCAUUCAUNN | 3176 |
| 1548-1566 | UGAAUGGUUCUUUAUCAUUNN | 2118 | AAUGAUAAAGAACCAUUCANN | 3177 |
| 1549-1567 | GAAUGGUUCUUUAUCAUUUNN | 2119 | AAAUGAUAAAGAACCAUUCNN | 3178 |
| 1550-1568 | AAUGGUUCUUUAUCAUUUCNN | 2120 | GAAAUGAUAAAGAACCAUUNN | 3179 |
| 1551-1569 | AUGGUUCUUUAUCAUUUCUNN | 2121 | AGAAAUGAUAAAGAACCAUNN | 3180 |
| 155-173 | UGCCGCUCAUGGUGCCAGCNN | 2122 | GCUGGCACCAUGAGCGGCANN | 3181 |
| 1552-1570 | UGGUUCUUUAUCAUUUCUCNN | 2123 | GAGAAAUGAUAAAGAACCANN | 3182 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1553-1571 | GGUUCUUUAUCAUUUCUCUNN | 2124 | AGAGAAAUGAUAAAGAACCNN | 3183 |
| 1554-1572 | GUUCUUUAUCAUUUCUCUUNN | 2125 | AAGAGAAAUGAUAAAGAACNN | 3184 |
| 1555-1573 | UUCUUUAUCAUUUCUCUUCNN | 2126 | GAAGAGAAAUGAUAAAGAANN | 3185 |
| 1556-1574 | UCUUUAUCAUUUCUCUUCCNN | 2127 | GGAAGAGAAAUGAUAAAGANN | 3186 |
| 1557-1575 | CUUUAUCAUUUCUCUUCCCNN | 2128 | GGGAAGAGAAAUGAUAAAGNN | 3187 |
| 1558-1576 | UUUAUCAUUUCUCUUCCCCNN | 2129 | GGGGAAGAGAAAUGAUAAANN | 3188 |
| 1559-1577 | UUAUCAUUUCUCUUCCCCCNN | 2130 | GGGGGAAGAGAAAUGAUAANN | 3189 |
| 1560-1578 | UAUCAUUUCUCUUCCCCCUNN | 2131 | AGGGGGAAGAGAAAUGAUANN | 3190 |
| 1561-1579 | AUCAUUUCUCUUCCCCCUUNN | 2132 | AAGGGGGAAGAGAAAUGAUNN | 3191 |
| 156-174 | GCCGCUCAUGGUGCCAGCCNN | 2133 | GGCUGGCACCAUGAGCGGCNN | 3192 |
| 1562-1580 | UCAUUUCUCUUCCCCCUUUNN | 2134 | AAAGGGGGAAGAGAAAUGANN | 3193 |
| 1563-1581 | CAUUUCUCUUCCCCCUUUUNN | 2135 | AAAAGGGGGAAGAGAAAUGNN | 3194 |
| 1564-1582 | AUUUCUCUUCCCCCUUUUUNN | 2136 | AAAAAGGGGGAAGAGAAAUNN | 3195 |
| 1565-1583 | UUUCUCUUCCCCCUUUUUGNN | 2137 | CAAAAAGGGGGAAGAGAAANN | 3196 |
| 1566-1584 | UUCUCUUCCCCCUUUUUGGNN | 2138 | CCAAAAAGGGGGAAGAGAANN | 3197 |
| 1567-1585 | UCUCUUCCCCCUUUUUGGCNN | 2139 | GCCAAAAAGGGGGAAGAGANN | 3198 |
| 1568-1586 | CUCUUCCCCCUUUUUGGCANN | 2140 | UGCCAAAAAGGGGGAAGAGNN | 3199 |
| 1569-1587 | UCUUCCCCCUUUUUGGCAUNN | 2141 | AUGCCAAAAAGGGGGAAGANN | 3200 |
| 1570-1588 | CUUCCCCCUUUUUGGCAUCNN | 2142 | GAUGCCAAAAAGGGGGAAGNN | 3201 |
| 1571-1589 | UUCCCCCUUUUUGGCAUCCNN | 2143 | GGAUGCCAAAAAGGGGGAANN | 3202 |
| 157-175 | CCGCUCAUGGUGCCAGCCCNN | 2144 | GGGCUGGCACCAUGAGCGGNN | 3203 |
| 1572-1590 | UCCCCCUUUUUGGCAUCCUNN | 2145 | AGGAUGCCAAAAAGGGGGANN | 3204 |
| 1573-1591 | CCCCCUUUUUGGCAUCCUGNN | 2146 | CAGGAUGCCAAAAAGGGGGNN | 3205 |
| 1574-1592 | CCCCUUUUUGGCAUCCUGGNN | 2147 | CCAGGAUGCCAAAAAGGGGNN | 3206 |
| 1575-1593 | CCCUUUUUGGCAUCCUGGCNN | 2148 | GCCAGGAUGCCAAAAAGGGNN | 3207 |
| 1576-1594 | CCUUUUUGGCAUCCUGGCUNN | 2149 | AGCCAGGAUGCCAAAAAGGNN | 3208 |
| 1577-1595 | CUUUUUGGCAUCCUGGCUUNN | 2150 | AAGCCAGGAUGCCAAAAAGNN | 3209 |
| 1578-1596 | UUUUUGGCAUCCUGGCUUGNN | 2151 | CAAGCCAGGAUGCCAAAAANN | 3210 |
| 1579-1597 | UUUUGGCAUCCUGGCUUGCNN | 2152 | GCAAGCCAGGAUGCCAAAANN | 3211 |
| 1580-1598 | UUUGGCAUCCUGGCUUGCCNN | 2153 | GGCAAGCCAGGAUGCCAAANN | 3212 |
| 1581-1599 | UUGGCAUCCUGGCUUGCCUNN | 2154 | AGGCAAGCCAGGAUGCCAANN | 3213 |
| 158-176 | CGCUCAUGGUGCCAGCCCANN | 2155 | UGGGCUGGCACCAUGAGCGNN | 3214 |
| 1582-1600 | UGGCAUCCUGGCUUGCCUCNN | 2156 | GAGGCAAGCCAGGAUGCCANN | 3215 |
| 1583-1601 | GGCAUCCUGGCUUGCCUCCNN | 2157 | GGAGGCAAGCCAGGAUGCCNN | 3216 |
| 1584-1602 | GCAUCCUGGCUUGCCUCCANN | 2158 | UGGAGGCAAGCCAGGAUGCNN | 3217 |
| 1585-1603 | CAUCCUGGCUUGCCUCCAGNN | 2159 | CUGGAGGCAAGCCAGGUAGNN | 3218 |
| 1586-1604 | AUCCUGGCUUGCCUCCAGUNN | 2160 | ACUGGAGGCAAGCCAGGAUNN | 3219 |
| 1587-1605 | UCCUGGCUUGCCUCCAGUUNN | 2161 | AACUGGAGGCAAGCCAGGANN | 3220 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1588-1606 | CCUGGCUUGCCUCCAGUUUUNN | 2162 | AAACUGGAGGCAAGCCAGGNN | 3221 |
| 1589-1607 | CUGGCUUGCCUCCAGUUUUUNN | 2163 | AAAACUGGAGGCAAGCCAGNN | 3222 |
| 1590-1608 | UGGCUUGCCUCCAGUUUUANN | 2164 | UAAAACUGGAGGCAAGCCANN | 3223 |
| 1591-1609 | GGCUUGCCUCCAGUUUUAGNN | 2165 | CUAAAACUGGAGGCAAGCCNN | 3224 |
| 159-177 | GCUCAUGGUGCCAGCCCAGNN | 2166 | CUGGGCUGGCACCAUGAGCNN | 3225 |
| 1592-1610 | GCUUGCCUCCAGUUUUAGGNN | 2167 | CCUAAAACUGGAGGCAAGCNN | 3226 |
| 1593-1611 | CUUGCCUCCAGUUUUAGGUNN | 2168 | ACCUAAAACUGGAGGCAAGNN | 3227 |
| 1594-1612 | UUGCCUCCAGUUUUAGGUCNN | 2169 | GACCUAAAACUGGAGGCAANN | 3228 |
| 1595-1613 | UGCCUCCAGUUUUAGGUCCNN | 2170 | GGACCUAAAACUGGAGGCANN | 3229 |
| 160-178 | CUCAUGGUGCCAGCCCAGANN | 2171 | UCUGGGCUGGCACCAUGAGNN | 3230 |
| 161-179 | UCAUGGUGCCAGCCCAGAGNN | 2172 | CUCUGGGCUGGCACCAUGANN | 3231 |
| 1615-1633 | UUAGUUUGCUUCUGUAAGCNN | 2173 | GCUUACAGAAGCAAACUAANN | 3232 |
| 1616-1634 | UAGUUUGCUUCUGUAAGCANN | 2174 | UGCUUACAGAAGCAAACUANN | 3233 |
| 1617-1635 | AGUUUGCUUCUGUAAGCAANN | 2175 | UUGCUUACAGAAGCAAACUNN | 3234 |
| 162-180 | CAUGGUGCCAGCCCAGAGANN | 2176 | UCUCUGGGCUGGCACCAUGNN | 3235 |
| 163-181 | AUGGUGCCAGCCCAGAGAGNN | 2177 | CUCUCUGGGCUGGCACCAUNN | 3236 |
| 1639-1657 | GAACACCUGCUGAGGGGCNN | 2178 | GCCCCCUCAGCAGGUGUUCNN | 3237 |
| 1640-1658 | AACACCUGCUGAGGGGCUNN | 2179 | AGCCCCCUCAGCAGGUGUUNN | 3238 |
| 1641-1659 | ACACCUGCUGAGGGGCUCNN | 2180 | GAGCCCCCUCAGCAGGUGUNN | 3239 |
| 164-182 | UGGUGCCAGCCCAGAGAGGNN | 2181 | CCUCUCUGGGCUGGCACCANN | 3240 |
| 1642-1660 | CACCUGCUGAGGGGCUCUNN | 2182 | AGAGCCCCCUCAGCAGGUGNN | 3241 |
| 1643-1661 | ACCUGCUGAGGGGCUCUUNN | 2183 | AAGAGCCCCCUCAGCAGGUNN | 3242 |
| 1644-1662 | CCUGCUGAGGGGCUCUUUNN | 2184 | AAAGAGCCCCCUCAGCAGGNN | 3243 |
| 1645-1663 | CUGCUGAGGGGCUCUUUCNN | 2185 | GAAAGAGCCCCCUCAGCAGNN | 3244 |
| 1646-1664 | UGCUGAGGGGCUCUUUCCNN | 2186 | GGAAAGAGCCCCCUCAGCANN | 3245 |
| 1647-1665 | GCUGAGGGGCUCUUUCCCNN | 2187 | GGGAAAGAGCCCCCUCAGCNN | 3246 |
| 1648-1666 | CUGAGGGGCUCUUUCCCUNN | 2188 | AGGGAAAGAGCCCCCUCAGNN | 3247 |
| 1649-1667 | UGAGGGGCUCUUUCCCUCNN | 2189 | GAGGGAAAGAGCCCCCUCANN | 3248 |
| 1650-1668 | GAGGGGCUCUUUCCCUCANN | 2190 | UGAGGGAAAGAGCCCCCUCNN | 3249 |
| 165-183 | GGUGCCAGCCCAGAGAGGGNN | 2191 | CCCUCUCUGGGCUGGCACCNN | 3250 |
| 166-184 | GUGCCAGCCCAGAGAGGGGNN | 2192 | CCCCUCUCUGGGCUGGCACNN | 3251 |
| 1670-1688 | GUAUACUUCAAGUAAGAUCNN | 2193 | GAUCUUACUUGAAGUAUACNN | 3252 |
| 1671-1689 | UAUACUUCAAGUAAGAUCANN | 2194 | UGAUCUUACUUGAAGUAUANN | 3253 |
| 167-185 | UGCCAGCCCAGAGAGGGGCNN | 2195 | GCCCCUCUCUGGGCUGGCANN | 3254 |
| 1672-1690 | AUACUUCAAGUAAGAUCAANN | 2196 | UUGAUCUUACUUGAAGUAUNN | 3255 |
| 1673-1691 | UACUUCAAGUAAGAUCAAGNN | 2197 | CUUGAUCUUACUUGAAGUANN | 3256 |
| 1674-1692 | ACUUCAAGUAAGAUCAAGANN | 2198 | UCUUGAUCUUACUUGAAGUNN | 3257 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1675-1693 | CUUCAAGUAAGAUCAAGAANN | 2199 | UUCUUGAUCUUACUUGAAGNN | 3258 |
| 1676-1694 | UUCAAGUAAGAUCAAGAAUNN | 2200 | AUUCUUGAUCUUACUUGAANN | 3259 |
| 1677-1695 | UCAAGUAAGAUCAAGAAUCNN | 2201 | GAUUCUUGAUCUUACUUGANN | 3260 |
| 1678-1696 | CAAGUAAGAUCAAGAAUCUNN | 2202 | AGAUUCUUGAUCUUACUUGNN | 3261 |
| 1679-1697 | AAGUAAGAUCAAGAAUCUUNN | 2203 | AAGAUUCUUGAUCUUACUUNN | 3262 |
| 1680-1698 | AGUAAGAUCAAGAAUCUUUNN | 2204 | AAAGAUUCUUGAUCUUACUNN | 3263 |
| 1681-1699 | GUAAGAUCAAGAAUCUUUUNN | 2205 | AAAAGAUUCUUGAUCUUACNN | 3264 |
| 1682-1700 | UAAGAUCAAGAAUCUUUUGNN | 2206 | CAAAAGAUUCUUGAUCUUANN | 3265 |
| 1683-1701 | AAGAUCAAGAAUCUUUUGUNN | 2207 | ACAAAAGAUUCUUGAUCUUNN | 3266 |
| 1684-1702 | AGAUCAAGAAUCUUUUGUGNN | 2208 | CACAAAAGAUUCUUGAUCUNN | 3267 |
| 1685-1703 | GAUCAAGAAUCUUUUGUGANN | 2209 | UCACAAAAGAUUCUUGAUCNN | 3268 |
| 1686-1704 | AUCAAGAAUCUUUUGUGAANN | 2210 | UUCACAAAAGAUUCUUGAUNN | 3269 |
| 1687-1705 | UCAAGAAUCUUUUGUGAAANN | 2211 | UUUCACAAAAGAUUCUUGANN | 3270 |
| 1707-1725 | UAUAGAAAUUUACUAUGUANN | 2212 | UACAUAGUAAAUUUCUAUANN | 3271 |
| 1708-1726 | AUAGAAAUUUACUAUGUAANN | 2213 | UUACAUAGUAAAUUUCUAUNN | 3272 |
| 1709-1727 | UAGAAAUUUACUAUGUAAANN | 2214 | UUUACAUAGUAAAUUUCUANN | 3273 |
| 1710-1728 | AGAAAUUUACUAUGUAAAUNN | 2215 | AUUUACAUAGUAAAUUUCNN | 3274 |
| 1711-1729 | GAAAUUUACUAUGUAAAUGNN | 2216 | CAUUUACAUAGUAAAUUUCNN | 3275 |
| 1712-1730 | AAAUUUACUAUGUAAAUGCNN | 2217 | GCAUUUACAUAGUAAAUUUNN | 3276 |
| 1713-1731 | AAUUUACUAUGUAAAUGCUNN | 2218 | AGCAUUUACAUAGUAAAUUNN | 3277 |
| 1714-1732 | AUUUACUAUGUAAAUGCUUNN | 2219 | AAGCAUUUACAUAGUAAAUNN | 3278 |
| 1715-1733 | UUUACUAUGUAAAUGCUUGNN | 2220 | CAAGCAUUUACAUAGUAAANN | 3279 |
| 1716-1734 | UUACUAUGUAAAUGCUUGANN | 2221 | UCAAGCAUUUACAUAGUAANN | 3280 |
| 1717-1735 | UACUAUGUAAAUGCUUGAUNN | 2222 | AUCAAGCAUUUACAUAGUANN | 3281 |
| 1718-1736 | ACUAUGUAAAUGCUUGAUGNN | 2223 | CAUCAAGCAUUUACAUAGUNN | 3282 |
| 1719-1737 | CUAUGUAAAUGCUUGAUGGNN | 2224 | CCAUCAAGCAUUUACAUAGNN | 3283 |
| 1720-1738 | UAUGUAAAUGCUUGAUGGANN | 2225 | UCCAUCAAGCAUUUACAUANN | 3284 |
| 1721-1739 | AUGUAAAUGCUUGAUGGAANN | 2226 | UUCCAUCAAGCAUUUACAUNN | 3285 |
| 1722-1740 | UGUAAAUGCUUGAUGGAAUNN | 2227 | AUUCCAUCAAGCAUUUACANN | 3286 |
| 1723-1741 | GUAAAUGCUUGAUGGAAUUNN | 2228 | AAUUCCAUCAAGCAUUUACNN | 3287 |
| 1724-1742 | UAAAUGCUUGAUGGAAUUUNN | 2229 | AAAUUCCAUCAAGCAUUUANN | 3288 |
| 1725-1743 | AAAUGCUUGAUGGAAUUUUNN | 2230 | AAAAUUCCAUCAAGCAUUUNN | 3289 |
| 1726-1744 | AAUGCUUGAUGGAAUUUUUNN | 2231 | AAAAAUUCCAUCAAGCAUUNN | 3290 |
| 1727-1745 | AUGCUUGAUGGAAUUUUUUNN | 2232 | AAAAAAUUCCAUCAAGCAUNN | 3291 |
| 1728-1746 | UGCUUGAUGGAAUUUUUUCNN | 2233 | GAAAAAAUUCCAUCAAGCANN | 3292 |
| 1729-1747 | GCUUGAUGGAAUUUUUUCCNN | 2234 | GGAAAAAAUUCCAUCAAGCNN | 3293 |
| 1730-1748 | CUUGAUGGAAUUUUUUCCUNN | 2235 | AGGAAAAAAUUCCAUCAAGNN | 3294 |
| 1731-1749 | UUGAUGGAAUUUUUUCCUGNN | 2236 | CAGGAAAAAAUUCCAUCAANN | 3295 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1732-1750 | UGAUGGAAUUUUUUCCUGCNN | 2237 | GCAGGAAAAAAUUCCAUCANN | 3296 |
| 1733-1751 | GAUGGAAUUUUUUCCUGCUNN | 2238 | AGCAGGAAAAAAUUCCAUCNN | 3297 |
| 1734-1752 | AUGGAAUUUUUUCCUGCUANN | 2239 | UAGCAGGAAAAAAUUCCAUNN | 3298 |
| 1735-1753 | UGGAAUUUUUUCCUGCUAGNN | 2240 | CUAGCAGGAAAAAAUUCCANN | 3299 |
| 1736-1754 | GGAAUUUUUUCCUGCUAGUNN | 2241 | ACUAGCAGGAAAAAAUUCCNN | 3300 |
| 1737-1755 | GAAUUUUUUCCUGCUAGUGNN | 2242 | CACUAGCAGGAAAAAAUUCNN | 3301 |
| 1738-1756 | AAUUUUUUCCUGCUAGUGUNN | 2243 | ACACUAGCAGGAAAAAAUUNN | 3302 |
| 1739-1757 | AUUUUUUCCUGCUAGUGUANN | 2244 | UACACUAGCAGGAAAAAAUNN | 3303 |
| 1740-1758 | UUUUUUCCUGCUAGUGUAGNN | 2245 | CUACACUAGCAGGAAAAAANN | 3304 |
| 1741-1759 | UUUUUCCUGCUAGUGUAGCNN | 2246 | GCUACACUAGCAGGAAAAANN | 3305 |
| 1742-1760 | UUUUCCUGCUAGUGUAGCUNN | 2247 | AGCUACACUAGCAGGAAAANN | 3306 |
| 1743-1761 | UUUCCUGCUAGUGUAGCUUNN | 2248 | AAGCUACACUAGCAGGAAANN | 3307 |
| 1744-1762 | UUCCUGCUAGUGUAGCUUCNN | 2249 | GAAGCUACACUAGCAGGAANN | 3308 |
| 1745-1763 | UCCUGCUAGUGUAGCUUCUNN | 2250 | AGAAGCUACACUAGCAGGANN | 3309 |
| 1746-1764 | CCUGCUAGUGUAGCUUCUGNN | 2251 | CAGAAGCUACACUAGCAGGNN | 3310 |
| 1747-1765 | CUGCUAGUGUAGCUUCUGANN | 2252 | UCAGAAGCUACACUAGCAGNN | 3311 |
| 1748-1766 | UGCUAGUGUAGCUUCUGAANN | 2253 | UUCAGAAGCUACACUAGCANN | 3312 |
| 1749-1767 | GCUAGUGUAGCUUCUGAAANN | 2254 | UUUCAGAAGCUACACUAGCNN | 3313 |
| 1750-1768 | CUAGUGUAGCUUCUGAAAGNN | 2255 | CUUUCAGAAGCUACACUAGNN | 3314 |
| 1751-1769 | UAGUGUAGCUUCUGAAAGGNN | 2256 | CCUUUCAGAAGCUACACUANN | 3315 |
| 1752-1770 | AGUGUAGCUUCUGAAAGGUNN | 2257 | ACCUUUCAGAAGCUACACUNN | 3316 |
| 1753-1771 | GUGUAGCUUCUGAAAGGUGNN | 2258 | CACCUUUCAGAAGCUACACNN | 3317 |
| 1754-1772 | UGUAGCUUCUGAAAGGUGCNN | 2259 | GCACCUUUCAGAAGCUACANN | 3318 |
| 1755-1773 | GUAGCUUCUGAAAGGUGCUNN | 2260 | AGCACCUUUCAGAAGCUACNN | 3319 |
| 1756-1774 | UAGCUUCUGAAAGGUGCUUNN | 2261 | AAGCACCUUUCAGAAGCUANN | 3320 |
| 1757-1775 | AGCUUCUGAAAGGUGCUUUNN | 2262 | AAAGCACCUUUCAGAAGCUNN | 3321 |
| 1758-1776 | GCUUCUGAAAGGUGCUUUCNN | 2263 | GAAAGCACCUUUCAGAAGCNN | 3322 |
| 1777-1795 | UCCAUUUAUUUAAAACUACNN | 2264 | GUAGUUUUAAAUAAAUGGANN | 3323 |
| 1778-1796 | CCAUUUAUUUAAAACUACCNN | 2265 | GGUAGUUUUAAAUAAAUGGNN | 3324 |
| 1779-1797 | CAUUUAUUUAAAACUACCCNN | 2266 | GGGUAGUUUUAAAUAAAUGNN | 3325 |
| 1780-1798 | AUUUAUUUAAAACUACCCANN | 2267 | UGGGUAGUUUUAAAUAAAUNN | 3326 |
| 1781-1799 | UUUAUUUAAAACUACCCAUNN | 2268 | AUGGGUAGUUUUAAAUAAANN | 3327 |
| 1782-1800 | UUAUUUAAAACUACCCAUGNN | 2269 | CAUGGGUAGUUUUAAAUAANN | 3328 |
| 1783-1801 | UAUUUAAAACUACCCAUGCNN | 2270 | GCAUGGGUAGUUUUAAAUANN | 3329 |
| 1784-1802 | AUUUAAAACUACCCAUGCANN | 2271 | UGCAUGGGUAGUUUUAAAUNN | 3330 |
| 1785-1803 | UUUAAAACUACCCAUGCAANN | 2272 | UUGCAUGGGUAGUUUUAAANN | 3331 |
| 1786-1804 | UUAAAACUACCCAUGCAAUNN | 2273 | AUUGCAUGGGUAGUUUUAANN | 3332 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 1787-1805 | UAAAACUACCCAUGCAAUUNN | 2274 | AAUUGCAUGGGUAGUUUUANN | 3333 |
| 1788-1806 | AAAACUACCCAUGCAAUUANN | 2275 | UAAUUGCAUGGGUAGUUUUNN | 3334 |
| 1789-1807 | AAACUACCCAUGCAAUUAANN | 2276 | UUAAUUGCAUGGGUAGUUUNN | 3335 |
| 1790-1808 | AACUACCCAUGCAAUUAAANN | 2277 | UUUAAUUGCAUGGGUAGUUNN | 3336 |
| 1791-1809 | ACUACCCAUGCAAUUAAAANN | 2278 | UUUUAAUUGCAUGGGUAGUNN | 3337 |
| 1792-1810 | CUACCCAUGCAAUUAAAAGNN | 2279 | CUUUUAAUUGCAUGGGUAGNN | 3338 |
| 1793-1811 | UACCCAUGCAAUUAAAAGGNN | 2280 | CCUUUUAAUUGCAUGGGUANN | 3339 |
| 1794-1812 | ACCCAUGCAAUUAAAAGGUNN | 2281 | ACCUUUUAAUUGCAUGGGUNN | 3340 |
| 1795-1813 | CCCAUGCAAUUAAAAGGUANN | 2282 | UACCUUUUAAUUGCAUGGGNN | 3341 |
| 1796-1814 | CCAUGCAAUUAAAAGGUACNN | 2283 | GUACCUUUUAAUUGCAUGGNN | 3342 |
| 1797-1815 | CAUGCAAUUAAAAGGUACANN | 2284 | UGUACCUUUUAAUUGCAUGNN | 3343 |
| 1798-1816 | AUGCAAUUAAAAGGUACAANN | 2285 | UUGUACCUUUUAAUUGCAUNN | 3344 |
| 1799-1817 | UGCAAUUAAAAGGUACAAUNN | 2286 | AUUGUACCUUUUAAUUGCANN | 3345 |
| 1800-1818 | GCAAUUAAAAGGUACAAUGNN | 2287 | CAUUGUACCUUUUAAUUGCNN | 3346 |
| 1801-1819 | CAAUUAAAAGGUACAAUGCNN | 2288 | GCAUUGUACCUUUUAAUUGNN | 3347 |
| 1802-1820 | AAUUAAAAGGUACAAUGCANN | 2289 | UGCAUUGUACCUUUUAAUUNN | 3348 |
| 187-205 | AGCCCGGAGGCAGCGAGCGNN | 2290 | CGCTCGCTGCCTCCGGGCTNN | 3349 |
| 188-206 | GCCCGGAGGCAGCGAGCGGNN | 2291 | CCGCTCGCTGCCTCCGGGCNN | 3350 |
| 189-207 | CCCGGAGGCAGCGAGCGGGNN | 2292 | CCCGCTCGCTGCCTCCGGGNN | 3351 |
| 190-208 | CCGGAGGCAGCGAGCGGGGNN | 2293 | CCCCGCTCGCTGCCTCCGGNN | 3352 |
| 191-209 | CGGAGGCAGCGAGCGGGGGNN | 2294 | CCCCCGCTCGCTGCCTCCGNN | 3353 |
| 192-210 | GGAGGCAGCGAGCGGGGGGNN | 2295 | CCCCCCGCTCGCTGCCTCCNN | 3354 |
| 193-211 | GAGGCAGCGAGCGGGGGGCNN | 2296 | GCCCCCCGCTCGCTGCCTCNN | 3355 |
| 194-212 | AGGCAGCGAGCGGGGGGCUNN | 2297 | AGCCCCCCGCUCGCUGCCUNN | 3356 |
| 195-213 | GGCAGCGAGCGGGGGGCUGNN | 2298 | CAGCCCCCCGCUCGCUGCCNN | 3357 |
| 196-214 | GCAGCGAGCGGGGGGCUGCNN | 2299 | GCAGCCCCCCGCUCGCUGCNN | 3358 |
| 197-215 | CAGCGAGCGGGGGGCUGCCNN | 2300 | GGCAGCCCCCCGCUCGCUGNN | 3359 |
| 198-216 | AGCGAGCGGGGGGCUGCCCNN | 2301 | GGGCAGCCCCCCGCUCGCUNN | 3360 |
| 199-217 | GCGAGCGGGGGGCUGCCCCNN | 2302 | GGGGCAGCCCCCCGCUCGCNN | 3361 |
| 200-218 | CGAGCGGGGGGCUGCCCCANN | 2303 | UGGGGCAGCCCCCCGCUCGNN | 3362 |
| 201-219 | GAGCGGGGGGCUGCCCCAGNN | 2304 | CUGGGGCAGCCCCCCGCUCNN | 3363 |
| 202-220 | AGCGGGGGGCUGCCCCAGGNN | 2305 | CCUGGGGCAGCCCCCCGCUNN | 3364 |
| 203-221 | GCGGGGGGCUGCCCCAGGCNN | 2306 | GCCUGGGGCAGCCCCCCGCNN | 3365 |
| 204-222 | CGGGGGGCUGCCCCAGGCGNN | 2307 | CGCCUGGGGCAGCCCCCCGNN | 3366 |
| 205-223 | GGGGGGCUGCCCCAGGCGCNN | 2308 | GCGCCUGGGGCAGCCCCCCNN | 3367 |
| 206-224 | GGGGGCUGCCCCAGGCGCGNN | 2309 | CGCGCCUGGGGCAGCCCCCNN | 3368 |
| 207-225 | GGGGCUGCCCCAGGCGCGCNN | 2310 | GCGCGCCUGGGGCAGCCCCNN | 3369 |
| 208-226 | GGGCUGCCCCAGGCGCGCANN | 2311 | UGCGCGCCUGGGGCAGCCCNN | 3370 |

TABLE 12 -continued

Sequences of dsRNA targeting both human and rhesus monkeyXBP-1.

| Target* | sense (5'-3') | SEQ ID NO | antisense (5'-3') | SEQ ID NO |
|---|---|---|---|---|
| 209-227 | GGCUGCCCCAGGCGCGCAANN | 2312 | UUGCGCGCCUGGGGCAGCCNN | 3371 |
| 210-228 | GCUGCCCCAGGCGCGCAAGNN | 2313 | CUUGCGCGCCUGGGGCAGCNN | 3372 |
| 211-229 | CUGCCCCAGGCGCGCAAGCNN | 2314 | GCUUGCGCGCCUGGGGCAGNN | 3373 |
| 212-230 | UGCCCCAGGCGCGCAAGCGNN | 2315 | CGCUUGCGCGCCUGGGGCANN | 3374 |
| 247-265 | CUGAGCCCCGAGGAGAAGGNN | 2316 | CCUUCUCCUCGGGGCUCAGNN | 3375 |
| 248-266 | UGAGCCCCGAGGAGAAGGCNN | 2317 | GCCUUCUCCUCGGGCUCANN | 3376 |
| 249-267 | GAGCCCCGAGGAGAAGGCGNN | 2318 | CGCCUUCUCCUCGGGGCUCNN | 3377 |
| 250-268 | AGCCCCGAGGAGAAGGCGCNN | 2319 | GCGCCUUCUCCUCGGGGCUNN | 3378 |
| 251-269 | GCCCCGAGGAGAAGGCGCUNN | 2320 | AGCGCCUUCUCCUCGGGCNN | 3379 |
| 252-270 | CCCCGAGGAGAAGGCGCUGNN | 2321 | CAGCGCCUUCUCCUCGGGGNN | 3380 |
| 253-271 | CCCGAGGAGAAGGCGCUGANN | 2322 | UCAGCGCCUUCUCCUCGGGNN | 3381 |
| 254-272 | CCGAGGAGAAGGCGCUGAGNN | 2323 | CUCAGCGCCUUCUCCUCGGNN | 3382 |
| 255-273 | CGAGGAGAAGGCGCUGAGGNN | 2324 | CCUCAGCGCCUUCUCCUCGNN | 3383 |
| 256-274 | GAGGAGAAGGCGCUGAGGANN | 2325 | UCCUCAGCGCCUUCUCCUCNN | 3384 |
| 257-275 | AGGAGAAGGCGCUGAGGAGNN | 2326 | CUCCUCAGCGCCUUCUCCUNN | 3385 |
| 258-276 | GGAGAAGGCGCUGAGGAGGNN | 2327 | CCUCCUCAGCGCCUUCUCCNN | 3386 |
| 259-277 | GAGAAGGCGCUGAGGAGGANN | 2328 | UCCUCCUCAGCGCCUUCUCNN | 3387 |
| 260-278 | AGAAGGCGCUGAGGAGGAANN | 2329 | UUCCUCCUCAGCGCCUUCUNN | 3388 |
| 261-279 | GAAGGCGCUGAGGAGGAAANN | 2330 | UUUCCUCCUCAGCGCCUUCNN | 3389 |
| 262-280 | AAGGCGCUGAGGAGGAAACNN | 2331 | GUUUCCUCCUCAGCGCCUUNN | 3390 |
| 263-281 | AGGCGCUGAGGAGGAAACUNN | 2332 | AGUUUCCUCCUCAGCGCCUNN | 3391 |
| 264-282 | GGCGCUGAGGAGGAAACUGNN | 2333 | CAGUUUCCUCCUCAGCGCCNN | 3392 |
| 265-283 | GCGCUGAGGAGGAAACUGANN | 2334 | UCAGUUUCCUCCUCAGCGCNN | 3393 |
| 266-284 | CGCUGAGGAGGAAACUGAANN | 2335 | UUCAGUUUCCUCCUCAGCGNN | 3394 |
| 267-285 | GCUGAGGAGGAAACUGAAANN | 2336 | UUUCAGUUUCCUCCUCAGCNN | 3395 |
| 268-286 | CUGAGGAGGAAACUGAAAANN | 2337 | UUUUCAGUUUCCUCCUCAGNN | 3396 |
| 269-287 | UGAGGAGGAAACUGAAAAANN | 2338 | UUUUUCAGUUUCCUCCUCANN | 3397 |
| 270-288 | GAGGAGGAAACUGAAAAACNN | 2339 | GUUUUUCAGUUUCCUCCUCNN | 3398 |
| 271-289 | AGGAGGAAACUGAAAAACANN | 2340 | UGUUUUUCAGUUUCCUCCUNN | 3399 |
| 272-290 | GGAGGAAACUGAAAAACAGNN | 2341 | CUGUUUUUCAGUUUCCUCCNN | 3400 |
| 273-291 | GAGGAAACUGAAAAACAGANN | 2342 | UCUGUUUUUCAGUUUCCUCNN | 3401 |
| 274-292 | AGGAAACUGAAAAACAGAGNN | 2343 | CUCUGUUUUUCAGUUUCCUNN | 3402 |
| 275-293 | GGAAACUGAAAAACAGAGUNN | 2344 | ACUCUGUUUUUCAGUUUCCNN | 3403 |
| 276-294 | GAAACUGAAAAACAGAGUANN | 2345 | UACUCUGUUUUUCAGUUUCNN | 3404 |
| 277-295 | AAACUGAAAAACAGAGUAGNN | 2346 | CUACUCUGUUUUUCAGUUUNN | 3405 |
| 278-296 | AACUGAAAAACAGAGUAGCNN | 2347 | GCUACUCUGUUUUUCAGUUNN | 3406 |
| 279-297 | ACUGAAAAACAGAGUAGCANN | 2348 | UGCUACUCUGUUUUUCAGUNN | 3407 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 280-298 | CUGAAAAACAGAGUAGCAGNN | 2349 | CUGCUACUCUGUUUUUCAGNN | 3408 |
| 281-299 | UGAAAAACAGAGUAGCAGCNN | 2350 | GCUGCUACUCUGUUUUUCANN | 3409 |
| 282-300 | GAAAAACAGAGUAGCAGCUNN | 2351 | AGCUGCUACUCUGUUUUUCNN | 3410 |
| 283-301 | AAAAACAGAGUAGCAGCUCNN | 2352 | GAGCUGCUACUCUGUUUUUNN | 3411 |
| 284-302 | AAAACAGAGUAGCAGCUCANN | 2353 | UGAGCUGCUACUCUGUUUUNN | 3412 |
| 285-303 | AAACAGAGUAGCAGCUCAGNN | 2354 | CUGAGCUGCUACUCUGUUUNN | 3413 |
| 286-304 | AACAGAGUAGCAGCUCAGANN | 2355 | UCUGAGCUGCUACUCUGUUNN | 3414 |
| 287-305 | ACAGAGUAGCAGCUCAGACNN | 2356 | GUCUGAGCUGCUACUCUGUNN | 3415 |
| 288-306 | CAGAGUAGCAGCUCAGACUNN | 2357 | AGUCUGAGCUGCUACUCUGNN | 3416 |
| 289-307 | AGAGUAGCAGCUCAGACUGNN | 2358 | CAGUCUGAGCUGCUACUCUNN | 3417 |
| 290-308 | GAGUAGCAGCUCAGACUGCNN | 2359 | GCAGUCUGAGCUGCUACUCNN | 3418 |
| 291-309 | AGUAGCAGCUCAGACUGCCNN | 2360 | GGCAGUCUGAGCUGCUACUNN | 3419 |
| 292-310 | GUAGCAGCUCAGACUGCCANN | 2361 | UGGCAGUCUGAGCUGCUACNN | 3420 |
| 293-311 | UAGCAGCUCAGACUGCCAGNN | 2362 | CUGGCAGUCUGAGCUGCUANN | 3421 |
| 294-312 | AGCAGCUCAGACUGCCAGANN | 2363 | UCUGGCAGUCUGAGCUGCUNN | 3422 |
| 295-313 | GCAGCUCAGACUGCCAGAGNN | 2364 | CUCUGGCAGUCUGAGCUGCNN | 3423 |
| 296-314 | CAGCUCAGACUGCCAGAGANN | 2365 | UCUCUGGCAGUCUGAGCUGNN | 3424 |
| 297-315 | AGCUCAGACUGCCAGAGAUNN | 2366 | AUCUCUGGCAGUCUGAGCUNN | 3425 |
| 298-316 | GCUCAGACUGCCAGAGAUCNN | 2367 | GAUCUCUGGCAGUCUGAGCNN | 3426 |
| 299-317 | CUCAGACUGCCAGAGAUCGNN | 2368 | CGAUCUCUGGCAGUCUGAGNN | 3427 |
| 300-318 | UCAGACUGCCAGAGAUCGANN | 2369 | UCGAUCUCUGGCAGUCUGANN | 3428 |
| 301-319 | CAGACUGCCAGAGAUCGAANN | 2370 | UUCGAUCUCUGGCAGUCUGNN | 3429 |
| 302-320 | AGACUGCCAGAGAUCGAAANN | 2371 | UUUCGAUCUCUGGCAGUCUNN | 3430 |
| 303-321 | GACUGCCAGAGAUCGAAAGNN | 2372 | CUUUCGAUCUCUGGCAGUCNN | 3431 |
| 304-322 | ACUGCCAGAGAUCGAAAGANN | 2373 | UCUUUCGAUCUCUGGCAGUNN | 3432 |
| 305-323 | CUGCCAGAGAUCGAAAGAANN | 2374 | UUCUUUCGAUCUCUGGCAGNN | 3433 |
| 325-343 | GCUCGAAUGAGUGAGCUGGNN | 2375 | CCAGCUCACUCAUUCGAGCNN | 3434 |
| 326-344 | CUCGAAUGAGUGAGCUGGANN | 2376 | UCCAGCUCACUCAUUCGAGNN | 3435 |
| 327-345 | UCGAAUGAGUGAGCUGGAANN | 2377 | UUCCAGCUCACUCAUUCGANN | 3436 |
| 328-346 | CGAAUGAGUGAGCUGGAACNN | 2378 | GUUCCAGCUCACUCAUUCGNN | 3437 |
| 329-347 | GAAUGAGUGAGCUGGAACANN | 2379 | UGUUCCAGGUCACUCAUUCNN | 3438 |
| 330-348 | AAUGAGUGAGCUGGAACAGNN | 2380 | CUGUUCCAGCUCACUCAUUNN | 3439 |
| 331-349 | AUGAGUGAGCUGGAACAGCNN | 2381 | GCUGUUCCAGCUCACUCAUNN | 3440 |
| 332-350 | UGAGUGAGCUGGAACAGCANN | 2382 | UGCUGUUCCAGCUCACUCANN | 3441 |
| 333-351 | GAGUGAGCUGGAACAGCAANN | 2383 | UUGCUGUUCCAGCUCACUCNN | 3442 |
| 334-352 | AGUGAGCUGGAACAGCAAGNN | 2384 | CUUGCUGUUCCAGCUCACUNN | 3443 |
| 335-353 | GUGAGCUGGAACAGCAAGUNN | 2385 | ACUUGCUGUUCCAGCUCACNN | 3444 |
| 336-354 | UGAGCUGGAACAGCAAGUGNN | 2386 | CACUUGCUGUUCCAGCUCANN | 3445 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 337-355 | GAGCUGGAACAGCAAGUGGNN | 2387 | CCACUUGCUGUUCCAGCUCNN | 3446 |
| 338-356 | AGCUGGAACAGCAAGUGGUNN | 2388 | ACCACUUGCUGUUCCAGCUNN | 3447 |
| 339-357 | GCUGGAACAGCAAGUGGUANN | 2389 | UACCACUUGCUGUUCCAGCNN | 3448 |
| 340-358 | CUGGAACAGCAAGUGGUAGNN | 2390 | CUACCACUUGCUGUUCCAGNN | 3449 |
| 341-359 | UGGAACAGCAAGUGGUAGANN | 2391 | UCUACCACUUGCUGUUCCANN | 3450 |
| 342-360 | GGAACAGCAAGUGGUAGAUNN | 2392 | AUCUACCACUUGCUGUUCCNN | 3451 |
| 343-361 | GAACAGCAAGUGGUAGAUUNN | 2393 | AAUCUACCACUUGCUGUUCNN | 3452 |
| 344-362 | AACAGCAAGUGGUAGAUUUNN | 2394 | AAAUCUACCACUUGCUGUUNN | 3453 |
| 345-363 | ACAGCAAGUGGUAGAUUUANN | 2395 | UAAAUCUACCACUUGCUGUNN | 3454 |
| 346-364 | CAGCAAGUGGUAGAUUUAGNN | 2396 | CUAAAUCUACCACUUGCUGNN | 3455 |
| 347-365 | AGCAAGUGGUAGAUUUAGANN | 2397 | UCUAAAUCUACCACUUGCUNN | 3456 |
| 348-366 | GCAAGUGGUAGAUUUAGAANN | 2398 | UUCUAAAUCUACCACUUGCNN | 3457 |
| 349-367 | CAAGUGGUAGAUUUAGAAGNN | 2399 | CUUCUAAAUCUACCACUUGNN | 3458 |
| 350-368 | AAGUGGUAGAUUUAGAAGANN | 2400 | UCUUCUAAAUCUACCACUUNN | 3459 |
| 351-369 | AGUGGUAGAUUUAGAAGAANN | 2401 | UUCUUCUAAAUCUACCACUNN | 3460 |
| 352-370 | GUGGUAGAUUUAGAAGAAGNN | 2402 | CUUCUUCUAAAUCUACCACNN | 3461 |
| 353-371 | UGGUAGAUUUAGAAGAAGANN | 2403 | UCUUCUUCUAAAUCUACCANN | 3462 |
| 354-372 | GGUAGAUUUAGAAGAAGAGNN | 2404 | CUCUUCUUCUAAAUCUACCNN | 3463 |
| 355-373 | GUAGAUUUAGAAGAAGAGANN | 2405 | UCUCUUCUUCUAAAUCUACNN | 3464 |
| 356-374 | UAGAUUUAGAAGAAGAGAANN | 2406 | UUCUCUUCUUCUAAAUCUANN | 3465 |
| 357-375 | AGAUUUAGAAGAAGAGAACNN | 2407 | GUUCUCUUCUUCUAAAUCUNN | 3466 |
| 358-376 | GAUUUAGAAGAAGAGAACCNN | 2408 | GGUUCUCUUCUUCUAAAUCNN | 3467 |
| 359-377 | AUUUAGAAGAAGAGAACCANN | 2409 | UGGUUCUCUUCUUCUAAAUNN | 3468 |
| 360-378 | UUUAGAAGAAGAGAACCAANN | 2410 | UUGGUUCUCUUCUUCUAAANN | 3469 |
| 361-379 | UUAGAAGAAGAGAACCAAANN | 2411 | UUUGGUUCUCUUCUUCUAANN | 3470 |
| 362-380 | UAGAAGAAGAGAACCAAAANN | 2412 | UUUUGGUUCUCUUCUUCUANN | 3471 |
| 363-381 | AGAAGAAGAGAACCAAAAANN | 2413 | TTTTTGGTTCTCTTCTTCTNN | 3472 |
| 364-382 | GAAGAAGAGAACCAAAAACNN | 2414 | GTTTTTGGTTCTCTTCTTCNN | 3473 |
| 365-383 | AAGAAGAGAACCAAAAACUNN | 2415 | AGUUUUGGUUCUCUUCUUNN | 3474 |
| 366-384 | AGAAGAGAACCAAAAACUUNN | 2416 | AAGUUUUGGUUCUCUUCUNN | 3475 |
| 367-385 | AAGAGAACCAAAAACUUUNN | 2417 | AAAGUUUUGGUUCUCUUCNN | 3476 |
| 368-386 | AAGAGAACCAAAAACUUUUNN | 2418 | AAAAGUUUUGGUUCUCUUNN | 3477 |
| 369-387 | AGAGAACCAAAAACUUUUGNN | 2419 | CAAAAGUUUUGGUUCUCUNN | 3478 |
| 370-388 | GAGAACCAAAAACUUUUGCNN | 2420 | GCAAAAGUUUUGGUUCUCNN | 3479 |
| 371-389 | AGAACCAAAAACUUUUGCUNN | 2421 | AGCAAAAGUUUUGGUUCUNN | 3480 |
| 372-390 | GAACCAAAAACUUUUGCUANN | 2422 | UAGCAAAAGUUUUGGUUCNN | 3481 |
| 373-391 | AACCAAAAACUUUUGCUAGNN | 2423 | CUAGCAAAAGUUUUGGUUNN | 3482 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 374-392 | ACCAAAAACUUUUGCUAGANN | 2424 | UCUAGCAAAAGUUUUUGGUNN | 3483 |
| 375-393 | CCAAAAACUUUUGCUAGAANN | 2425 | UUCUAGCAAAAGUUUUUGGNN | 3484 |
| 376-394 | CAAAAACUUUUGCUAGAAANN | 2426 | UUUCUAGCAAAAGUUUUUGNN | 3485 |
| 377-395 | AAAAACUUUUGCUAGAAAANN | 2427 | UUUUCUAGCAAAAGUUUUUNN | 3486 |
| 378-396 | AAAACUUUUGCUAGAAAAUNN | 2428 | AUUUUCUAGCAAAAGUUUUNN | 3487 |
| 379-397 | AAACUUUUGCUAGAAAAUCNN | 2429 | GAUUUUCUAGCAAAAGUUUNN | 3488 |
| 380-398 | AACUUUUGCUAGAAAAUCANN | 2430 | UGAUUUUCUAGCAAAAGUUNN | 3489 |
| 381-399 | ACUUUUGCUAGAAAAUCAGNN | 2431 | CUGAUUUUCUAGCAAAAGUNN | 3490 |
| 382-400 | CUUUUGCUAGAAAAUCAGCNN | 2432 | GCUGAUUUUCUAGCAAAAGNN | 3491 |
| 383-401 | UUUUGCUAGAAAAUCAGCUNN | 2433 | AGCUGAUUUUCUAGCAAAANN | 3492 |
| 384-402 | UUUGCUAGAAAAUCAGCUUNN | 2434 | AAGCUGAUUUUCUAGCAAANN | 3493 |
| 385-403 | UUGCUAGAAAAUCAGCUUUNN | 2435 | AAAGCUGAUUUUCUAGCAANN | 3494 |
| 386-404 | UGCUAGAAAAUCAGCUUUUNN | 2436 | AAAAGCUGAUUUUCUAGCANN | 3495 |
| 387-405 | GCUAGAAAAUCAGCUUUUANN | 2437 | UAAAAGCUGAUUUUCUAGCNN | 3496 |
| 388-406 | CUAGAAAAUCAGCUUUUACNN | 2438 | GUAAAAGCUGAUUUUCUAGNN | 3497 |
| 389-407 | UAGAAAAUCAGCUUUUACGNN | 2439 | CGUAAAAGCUGAUUUUCUANN | 3498 |
| 390-408 | AGAAAAUCAGCUUUUACGANN | 2440 | UCGUAAAAGCUGAUUUUCUNN | 3499 |
| 391-409 | GAAAAUCAGCUUUUACGAGNN | 2441 | CUCGUAAAAGCUGAUUUUCNN | 3500 |
| 392-410 | AAAAUCAGCUUUUACGAGANN | 2442 | UCUCGUAAAAGCUGAUUUUNN | 3501 |
| 393-411 | AAAUCAGCUUUUACGAGAGNN | 2443 | CUCUCGUAAAAGCUGAUUUNN | 3502 |
| 394-412 | AAUCAGCUUUUACGAGAGANN | 2444 | UCUCUCGUAAAAGCUGAUUNN | 3503 |
| 395-413 | AUCAGCUUUUACGAGAGAANN | 2445 | UUCUCUCGUAAAAGCUGAUNN | 3504 |
| 396-414 | UCAGCUUUUACGAGAGAAANN | 2446 | UUUCUCUCGUAAAAGCUGANN | 3505 |
| 397-415 | CAGCUUUUACGAGAGAAAANN | 2447 | UUUUCUCUCGUAAAAGCUGNN | 3506 |
| 398-416 | AGCUUUUACGAGAGAAAACNN | 2448 | GUUUUCUCUCGUAAAAGCUNN | 3507 |
| 399-417 | GCUUUUACGAGAGAAAACUNN | 2449 | AGUUUUCUCUCGUAAAAGCNN | 3508 |
| 400-418 | CUUUUACGAGAGAAAACUCNN | 2450 | GAGUUUUCUCUCGUAAAAGNN | 3509 |
| 401-419 | UUUUACGAGAGAAAACUCANN | 2451 | UGAGUUUUCUCUCGUAAAANN | 3510 |
| 421-439 | GGCCUUGUAGUUGAGAACCNN | 2452 | GGUUCUCAACUACAAGGCCNN | 3511 |
| 422-440 | GCCUUGUAGUUGAGAACCANN | 2453 | UGGUUCUCAACUACAAGGCNN | 3512 |
| 423-441 | CCUUGUAGUUGAGAACCAGNN | 2454 | CUGGUUCUCAACUACAAGGNN | 3513 |
| 424-442 | CUUGUAGUUGAGAACCAGGNN | 2455 | CCUGGUUCUCAACUACAAGNN | 3514 |
| 425-443 | UUGUAGUUGAGAACCAGGANN | 2456 | UCCUGGUUCUCAACUACAANN | 3515 |
| 426-444 | UGUAGUUGAGAACCAGGAGNN | 2457 | CUCCUGGUUCUCAACUACANN | 3516 |
| 427-445 | GUAGUUGAGAACCAGGAGUNN | 2458 | ACUCCUGGUUCUCAACUACNN | 3517 |
| 428-446 | UAGUUGAGAACCAGGAGUUNN | 2459 | AACUCCUGGUUCUCAACUANN | 3518 |
| 429-447 | AGUUGAGAACCAGGAGUUANN | 2460 | UAACUCCUGGUUCUCAACUNN | 3519 |
| 430-448 | GUUGAGAACCAGGAGUUAANN | 2461 | UUAACUCCUGGUUCUCAACNN | 3520 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 431-449 | UUGAGAACCAGGAGUUAAGNN | 2462 | CUUAACUCCUGGUUCUCAANN | 3521 |
| 432-450 | UGAGAACCAGGAGUUAAGANN | 2463 | UCUUAACUCCUGGUUCUCANN | 3522 |
| 433-451 | GAGAACCAGGAGUUAAGACNN | 2464 | GUCUUAACUCCUGGUUCUCNN | 3523 |
| 434-452 | AGAACCAGGAGUUAAGACANN | 2465 | UGUCUUAACUCCUGGUUCUNN | 3524 |
| 435-453 | GAACCAGGAGUUAAGACAGNN | 2466 | CUGUCUUAACUCCUGGUUCNN | 3525 |
| 436-454 | AACCAGGAGUUAAGACAGCNN | 2467 | GCUGUCUUAACUCCUGGUUNN | 3526 |
| 437-455 | ACCAGGAGUUAAGACAGCGNN | 2468 | CGCUGUCUUAACUCCUGGUNN | 3527 |
| 438-456 | CCAGGAGUUAAGACAGCGCNN | 2469 | GCGCUGUCUUAACUCCUGGNN | 3528 |
| 44-62 | GAGCUAUGGUGGUGGUGGCNN | 2470 | GCCACCACCACCAUAGCUCNN | 3529 |
| 45-63 | AGCUAUGGUGGUGGUGGCANN | 2471 | UGCCACCACCACCAUAGCUNN | 3530 |
| 458-476 | UGGGGAUGGAUGCCCUGGUNN | 2472 | ACCAGGGCAUCCAUCCCCANN | 3531 |
| 459-477 | GGGGAUGGAUGCCCUGGUUNN | 2473 | AACCAGGGCAUCCAUCCCNN | 3532 |
| 460-478 | GGGAUGGAUGCCCUGGUUGNN | 2474 | CAACCAGGGCAUCCAUCCCNN | 3533 |
| 461-479 | GGAUGGAUGCCCUGGUUGCNN | 2475 | GCAACCAGGGCAUCCAUCCNN | 3534 |
| 462-480 | GAUGGAUGCCCUGGUUGCUNN | 2476 | AGCAACCAGGGCAUCCAUCNN | 3535 |
| 46-64 | GCUAUGGUGGUGGUGGCAGNN | 2477 | CUGCCACCACCACCAUAGCNN | 3536 |
| 47-65 | CUAUGGUGGUGGUGGCAGCNN | 2478 | GCUGCCACCACCACCAUAGNN | 3537 |
| 482-500 | AAGAGGAGGCGGAAGCCAANN | 2479 | TTGGCTTCCGCCTCCTCTTNN | 3538 |
| 483-501 | AGAGGAGGCGGAAGCCAAGNN | 2480 | CTTGGCTTCCGCCTCCTCTNN | 3539 |
| 484-502 | GAGGAGGCGGAAGCCAAGGNN | 2481 | CCTTGGCTTCCGCCTCCTCNN | 3540 |
| 485-503 | AGGAGGCGGAAGCCAAGGGNN | 2482 | CCCTTGGCTTCCGCCTCCTNN | 3541 |
| 486-504 | GGAGGCGGAAGCCAAGGGGNN | 2483 | CCCCTTGGCTTCCGCCTCCNN | 3542 |
| 48-66 | UAUGGUGGUGGUGGCAGCCNN | 2484 | GGCUGCCACCACCACCAUANN | 3543 |
| 487-505 | GAGGCGGAAGCCAAGGGGANN | 2485 | TCCCCTTGGCTTCCGCCTCNN | 3544 |
| 488-506 | AGGCGGAAGCCAAGGGGAANN | 2486 | TTCCCCTTGGCTTCCGCCTNN | 3545 |
| 489-507 | GGCGGAAGCCAAGGGGAAUNN | 2487 | AUUCCCCUUGGCUUCCGCCNN | 3546 |
| 490-508 | GCGGAAGCCAAGGGGAAUGNN | 2488 | CAUUCCCCUUGGCUUCCGCNN | 3547 |
| 49-67 | AUGGUGGUGGUGGCAGCCGNN | 2489 | CGGCUGCCACCACCACCAUNN | 3548 |
| 50-68 | UGGUGGUGGUGGCAGCCGCNN | 2490 | GCGGCUGCCACCACCACCANN | 3549 |
| 510-528 | AGUGAGGCCAGUGGCCGGGNN | 2491 | CCCGGCCACUGGCCUCACUNN | 3550 |
| 511-529 | GUGAGGCCAGUGGCCGGGUNN | 2492 | ACCCGGCCACUGGCCUCACNN | 3551 |
| 512-530 | UGAGGCCAGUGGCCGGGUCNN | 2493 | GACCCGGCCACUGGCCUCANN | 3552 |
| 513-531 | GAGGCCAGUGGCCGGGUCUNN | 2494 | AGACCCGGCCACUGGCCUCNN | 3553 |
| 514-532 | AGGCCAGUGGCCGGGUCUGNN | 2495 | CAGACCCGGCCACUGGCCUNN | 3554 |
| 515-533 | GGCCAGUGGCCGGGUCUGCNN | 2496 | GCAGACCCGGCCACUGGCCNN | 3555 |
| 516-534 | GCCAGUGGCCGGGUCUGCUNN | 2497 | AGCAGACCCGGCCACUGGCNN | 3556 |
| 517-535 | CCAGUGGCCGGGUCUGCUGNN | 2498 | CAGCAGACCCGGCCACUGGNN | 3557 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 518-536 | CAGUGGCCGGGUCUGCUGANN | 2499 | UCAGCAGACCCGGCCACUGNN | 3558 |
| 519-537 | AGUGGCCGGGUCUGCUGAGNN | 2500 | CUCAGCAGACCCGGCCACUNN | 3559 |
| 520-538 | GUGGCCGGGUCUGCUGAGUNN | 2501 | ACUCAGCAGACCCGGCCACNN | 3560 |
| 521-539 | UGGCCGGGUCUGCUGAGUCNN | 2502 | GACUCAGCAGACCCGGCCANN | 3561 |
| 522-540 | GGCCGGGUCUGCUGAGUCCNN | 2503 | GGACUCAGCAGACCCGGCCNN | 3562 |
| 523-541 | GCCGGGUCUGCUGAGUCCGNN | 2504 | CGGACUCAGCAGACCCGGCNN | 3563 |
| 524-542 | CCGGGUCUGCUGAGUCCGCNN | 2505 | GCGGACUCAGCAGACCCGGNN | 3564 |
| 525-543 | CGGGUCUGCUGAGUCCGCANN | 2506 | UGCGGACUCAGCAGACCCGNN | 3565 |
| 526-544 | GGGUCUGCUGAGUCCGCAGNN | 2507 | CUGCGGACUCAGCAGACCCNN | 3566 |
| 574-592 | GUGCAGGCCCAGUUGUCACNN | 2508 | GUGACAACUGGGCCUGCACNN | 3567 |
| 575-593 | UGCAGGCCCAGUUGUCACCNN | 2509 | GGUGACAACUGGGCCUGCANN | 3568 |
| 576-594 | GCAGGCCCAGUUGUCACCCNN | 2510 | GGGUGACAACUGGGCCUGCNN | 3569 |
| 577-595 | CAGGCCCAGUUGUCACCCCNN | 2511 | GGGGUGACAACUGGGCCUGNN | 3570 |
| 578-596 | AGGCCCAGUUGUCACCCCUNN | 2512 | AGGGGUGACAACUGGGCCUNN | 3571 |
| 579-597 | GGCCCAGUUGUCACCCCUCNN | 2513 | GAGGGGUGACAACUGGGCCNN | 3572 |
| 580-598 | GCCCAGUUGUCACCCCUCCNN | 2514 | GGAGGGGUGACAACUGGGCNN | 3573 |
| 581-599 | CCCAGUUGUCACCCCUCCANN | 2515 | UGGAGGGGUGACAACUGGGNN | 3574 |
| 582-600 | CCAGUUGUCACCCCUCCAGNN | 2516 | CUGGAGGGGUGACAACUGGNN | 3575 |
| 583-601 | CAGUUGUCACCCCUCCAGANN | 2517 | UCUGGAGGGGUGACAACUGNN | 3576 |
| 584-602 | AGUUGUCACCCCUCCAGAANN | 2518 | UUCUGGAGGGGUGACAACUNN | 3577 |
| 585-603 | GUUGUCACCCCUCCAGAACNN | 2519 | GUUCUGGAGGGGUGACAACNN | 3578 |
| 586-604 | UUGUCACCCCUCCAGAACANN | 2520 | UGUUCUGGAGGGGUGACAANN | 3579 |
| 587-605 | UGUCACCCCUCCAGAACAUNN | 2521 | AUGUUCUGGAGGGGUGACANN | 3580 |
| 588-606 | GUCACCCCUCCAGAACAUCNN | 2522 | GAUGUUCUGGAGGGGUGACNN | 3581 |
| 589-607 | UCACCCCUCCAGAACAUCUNN | 2523 | AGAUGUUCUGGAGGGGUGANN | 3582 |
| 590-608 | CACCCCUCCAGAACAUCUCNN | 2524 | GAGAUGUUCUGGAGGGGUGNN | 3583 |
| 591-609 | ACCCCUCCAGAACAUCUCCNN | 2525 | GGAGAUGUUCUGGAGGGGUNN | 3584 |
| 592-610 | CCCCUCCAGAACAUCUCCCNN | 2526 | GGGAGAUGUUCUGGAGGGGNN | 3585 |
| 593-611 | CCCUCCAGAACAUCUCCCCNN | 2527 | GGGGAGAUGUUCUGGAGGGNN | 3586 |
| 594-612 | CCUCCAGAACAUCUCCCCANN | 2528 | UGGGGAGAUGUUCUGGAGGNN | 3587 |
| 595-613 | CUCCAGAACAUCUCCCCAUNN | 2529 | AUGGGGAGAUGUUCUGGAGNN | 3588 |
| 596-614 | UCCAGAACAUCUCCCCAUGNN | 2530 | CAUGGGGAGAUGUUCUGGANN | 3589 |
| 597-615 | CCAGAACAUCUCCCCAUGGNN | 2531 | CCAUGGGGAGAUGUUCUGGNN | 3590 |
| 598-616 | CAGAACAUCUCCCCAUGGANN | 2532 | UCCAUGGGGAGAUGUUCUGNN | 3591 |
| 599-617 | AGAACAUCUCCCCAUGGAUNN | 2533 | AUCCAUGGGGAGAUGUUCUNN | 3592 |
| 600-618 | GAACAUCUCCCCAUGGAUUNN | 2534 | AAUCCAUGGGGAGAUGUUCNN | 3593 |
| 601-619 | AACAUCUCCCCAUGGAUUCNN | 2535 | GAAUCCAUGGGGAGAUGUUNN | 3594 |
| 602-620 | ACAUCUCCCCAUGGAUUCUNN | 2536 | AGAAUCCAUGGGGAGAUGUNN | 3595 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 603-621 | CAUCUCCCCAUGGAUUCUGNN | 2537 | CAGAAUCCAUGGGGAGAUGNN | 3596 |
| 604-622 | AUCUCCCCAUGGAUUCUGGNN | 2538 | CCAGAAUCCAUGGGGAGAUNN | 3597 |
| 605-623 | UCUCCCCAUGGAUUCUGGCNN | 2539 | GCCAGAAUCCAUGGGGAGANN | 3598 |
| 606-624 | CUCCCCAUGGAUUCUGGCGNN | 2540 | CGCCAGAAUCCAUGGGGAGNN | 3599 |
| 607-625 | UCCCCAUGGAUUCUGGCGGNN | 2541 | CCGCCAGAAUCCAUGGGGNN | 3600 |
| 608-626 | CCCCAUGGAUUCUGGCGGUNN | 2542 | ACCGCCAGAAUCCAUGGGGNN | 3601 |
| 609-627 | CCCAUGGAUUCUGGCGGUANN | 2543 | UACCGCCAGAAUCCAUGGGNN | 3602 |
| 610-628 | CCAUGGAUUCUGGCGGUAUNN | 2544 | AUACCGCCAGAAUCCAUGGNN | 3603 |
| 611-629 | CAUGGAUUCUGGCGGUAUUNN | 2545 | AAUACCGCCAGAAUCCAUGNN | 3604 |
| 612-630 | AUGGAUUCUGGCGGUAUUGNN | 2546 | CAAUACCGCCAGAAUCCAUNN | 3605 |
| 613-631 | UGGAUUCUGGCGGUAUUGANN | 2547 | UCAAUACCGCCAGAAUCCNN | 3606 |
| 614-632 | GGAUUCUGGCGGUAUUGACNN | 2548 | GUCAAUACCGCCAGAAUCCNN | 3607 |
| 615-633 | GAUUCUGGCGGUAUUGACUNN | 2549 | AGUCAAUACCGCCAGAAUCNN | 3608 |
| 616-634 | AUUCUGGCGGUAUUGACUCNN | 2550 | GAGUCAAUACCGCCAGAAUNN | 3609 |
| 617-635 | UUCUGGCGGUAUUGACUCUNN | 2551 | AGAGUCAAUACCGCCAGAANN | 3610 |
| 618-636 | UCUGGCGGUAUUGACUCUUNN | 2552 | AAGAGUCAAUACCGCCAGANN | 3611 |
| 619-637 | CUGGCGGUAUUGACUCUUCNN | 2553 | GAAGAGUCAAUACCGCCAGNN | 3612 |
| 620-638 | UGGCGGUAUUGACUCUUCANN | 2554 | UGAAGAGUCAAUACCGCCANN | 3613 |
| 621-639 | GGCGGUAUUGACUCUUCAGNN | 2555 | CUGAAGAGUCAAUACCGCCNN | 3614 |
| 622-640 | GCGGUAUUGACUCUUCAGANN | 2556 | UCUGAAGAGUCAAUACCGCNN | 3615 |
| 623-641 | CGGUAUUGACUCUUCAGAUNN | 2557 | AUCUGAAGAGUCAAUACCGNN | 3616 |
| 624-642 | GGUAUUGACUCUUCAGAUUNN | 2558 | AAUCUGAAGAGUCAAUACCNN | 3617 |
| 625-643 | GUAUUGACUCUUCAGAUUCNN | 2559 | GAAUCUGAAGAGUCAAUACNN | 3618 |
| 626-644 | UAUUGACUCUUCAGAUUCANN | 2560 | UGAAUCUGAAGAGUCAAUANN | 3619 |
| 627-645 | AUUGACUCUUCAGAUUCAGNN | 2561 | CUGAAUCUGAAGAGUCAAUNN | 3620 |
| 628-646 | UUGACUCUUCAGAUUCAGANN | 2562 | UCUGAAUCUGAAGAGUCAANN | 3621 |
| 629-647 | UGACUCUUCAGAUUCAGAGNN | 2563 | CUCUGAAUCUGAAGAGUCANN | 3622 |
| 630-648 | GACUCUUCAGAUUCAGAGUNN | 2564 | ACUCUGAAUCUGAAGAGUCNN | 3623 |
| 631-649 | ACUCUUCAGAUUCAGAGUCNN | 2565 | GACUCUGAAUCUGAAGAGUNN | 3624 |
| 632-650 | CUCUUCAGAUUCAGAGUCUNN | 2566 | AGACUCUGAAUCUGAAGAGNN | 3625 |
| 633-651 | UCUUCAGAUUCAGAGUCUGNN | 2567 | CAGACUCUGAAUCUGAAGANN | 3626 |
| 634-652 | CUUCAGAUUCAGAGUCUGANN | 2568 | UCAGACUCUGAAUCUGAAGNN | 3627 |
| 635-653 | UUCAGAUUCAGAGUCUGAUNN | 2569 | AUCAGACUCUGAAUCUGAANN | 3628 |
| 636-654 | UCAGAUUCAGAGUCUGAUANN | 2570 | UAUCAGACUCUGAAUCUGANN | 3629 |
| 637-655 | CAGAUUCAGAGUCUGAUAUNN | 2571 | AUAUCAGACUCUGAAUCUGNN | 3630 |
| 638-656 | AGAUUCAGAGUCUGAUAUCNN | 2572 | GAUAUCAGACUCUGAAUCUNN | 3631 |
| 639-657 | GAUUCAGAGUCUGAUAUCCNN | 2573 | GGAUAUCAGACUCUGAAUCNN | 3632 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 640-658 | AUUCAGAGUCUGAUAUCCUNN | 2574 | AGGAUAUCAGACUCUGAAUNN | 3633 |
| 641-659 | UUCAGAGUCUGAUAUCCUGNN | 2575 | CAGGAUAUCAGACUCUGAANN | 3634 |
| 642-660 | UCAGAGUCUGAUAUCCUGUNN | 2576 | ACAGGAUAUCAGACUCUGANN | 3635 |
| 643-661 | CAGAGUCUGAUAUCCUGUUNN | 2577 | AACAGGAUAUCAGACUCUGNN | 3636 |
| 644-662 | AGAGUCUGAUAUCCUGUUGNN | 2578 | CAACAGGAUAUCAGACUCUNN | 3637 |
| 645-663 | GAGUCUGAUAUCCUGUUGGNN | 2579 | CCAACAGGAUAUCAGACUCNN | 3638 |
| 646-664 | AGUCUGAUAUCCUGUUGGGNN | 2580 | CCCAACAGGAUAUCAGACUNN | 3639 |
| 647-665 | GUCUGAUAUCCUGUUGGGCNN | 2581 | GCCCAACAGGAUAUCAGACNN | 3640 |
| 648-666 | UCUGAUAUCCUGUUGGGCANN | 2582 | UGCCCAACAGGAUAUCAGANN | 3641 |
| 649-667 | CUGAUAUCCUGUUGGGCAUNN | 2583 | AUGCCCAACAGGAUAUCAGNN | 3642 |
| 650-668 | UGAUAUCCUGUUGGGCAUUNN | 2584 | AAUGCCCAACAGGAUAUCANN | 3643 |
| 651-669 | GAUAUCCUGUUGGGCAUUCNN | 2585 | GAAUGCCCAACAGGAUAUCNN | 3644 |
| 652-670 | AUAUCCUGUUGGGCAUUCUNN | 2586 | AGAAUGCCCAACAGGAUAUNN | 3645 |
| 653-671 | UAUCCUGUUGGGCAUUCUGNN | 2587 | CAGAAUGCCCAACAGGAUANN | 3646 |
| 654-672 | AUCCUGUUGGGCAUUCUGGNN | 2588 | CCAGAAUGCCCAACAGGAUNN | 3647 |
| 655-673 | UCCUGUUGGGCAUUCUGGANN | 2589 | UCCAGAAUGCCCAACAGGANN | 3648 |
| 656-674 | CCUGUUGGGCAUUCUGGACNN | 2590 | GUCCAGAAUGCCCAACAGGNN | 3649 |
| 657-675 | CUGUUGGGCAUUCUGGACANN | 2591 | UGUCCAGAAUGCCCAACAGNN | 3650 |
| 658-676 | UGUUGGGCAUUCUGGACAANN | 2592 | UUGUCCAGAAUGCCCAACANN | 3651 |
| 659-677 | GUUGGGCAUUCUGGACAACNN | 2593 | GUUGUCCAGAAUGCCCAACNN | 3652 |
| 660-678 | UUGGGCAUUCUGGACAACUNN | 2594 | AGUUGUCCAGAAUGCCCAANN | 3653 |
| 661-679 | UGGGCAUUCUGGACAACUUNN | 2595 | AAGUUGUCCAGAAUGCCCANN | 3654 |
| 662-680 | GGGCAUUCUGGACAACUUGNN | 2596 | CAAGUUGUCCAGAAUGCCCNN | 3655 |
| 663-681 | GGCAUUCUGGACAACUUGGNN | 2597 | CCAAGUUGUCCAGAAUGCCNN | 3656 |
| 664-682 | GCAUUCUGGACAACUUGGANN | 2598 | UCCAAGUUGUCCAGAAUGCNN | 3657 |
| 665-683 | CAUUCUGGACAACUUGGACNN | 2599 | GUCCAAGUUGUCCAGAAUGNN | 3658 |
| 666-684 | AUUCUGGACAACUUGGACCNN | 2600 | GGUCCAAGUUGUCCAGAAUNN | 3659 |
| 667-685 | UUCUGGACAACUUGGACCCNN | 2601 | GGGUCCAAGUUGUCCAGAANN | 3660 |
| 668-686 | UCUGGACAACUUGGACCCANN | 2602 | UGGGUCCAAGUUGUCCAGANN | 3661 |
| 669-687 | CUGGACAACUUGGACCCAGNN | 2603 | CUGGGUCCAAGUUGUCCAGNN | 3662 |
| 670-688 | UGGACAACUUGGACCCAGUNN | 2604 | ACUGGGUCCAAGUUGUCCANN | 3663 |
| 671-689 | GGACAACUUGGACCCAGUCNN | 2605 | GACUGGGUCCAAGUUGUCCNN | 3664 |
| 672-690 | GACAACUUGGACCCAGUCANN | 2606 | UGACUGGGUCCAAGUUGUCNN | 3665 |
| 673-691 | ACAACUUGGACCCAGUCAUNN | 2607 | AUGACUGGGUCCAAGUUGUNN | 3666 |
| 674-692 | CAACUUGGACCCAGUCAUGNN | 2608 | CAUGACUGGGUCCAAGUUGNN | 3667 |
| 675-693 | AACUUGGACCCAGUCAUGUNN | 2609 | ACAUGACUGGGUCCAAGUUNN | 3668 |
| 676-694 | ACUUGGACCCAGUCAUGUUNN | 2610 | AACAUGACUGGGUCCAAGUNN | 3669 |
| 677-695 | CUUGGACCCAGUCAUGUUCNN | 2611 | GAACAUGACUGGGUCCAAGNN | 3670 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 678-696 | UUGGACCCAGUCAUGUUCUNN | 2612 | AGAACAUGACUGGGUCCAANN | 3671 |
| 679-697 | UGGACCCAGUCAUGUUCUUNN | 2613 | AAGAACAUGACUGGGUCCANN | 3672 |
| 680-698 | GGACCCAGUCAUGUUCUUCNN | 2614 | GAAGAACAUGACUGGGUCCNN | 3673 |
| 681-699 | GACCCAGUCAUGUUCUUCANN | 2615 | UGAAGAACAUGACUGGGUCNN | 3674 |
| 682-700 | ACCCAGUCAUGUUCUUCAANN | 2616 | UUGAAGAACAUGACUGGGUNN | 3675 |
| 683-701 | CCCAGUCAUGUUCUUCAAANN | 2617 | UUUGAAGAACAUGACUGGGNN | 3676 |
| 684-702 | CCAGUCAUGUUCUUCAAAUNN | 2618 | AUUUGAAGAACAUGACUGGNN | 3677 |
| 685-703 | CAGUCAUGUUCUUCAAAUGNN | 2619 | CAUUUGAAGAACAUGACUGNN | 3678 |
| 686-704 | AGUCAUGUUCUUCAAAUGCNN | 2620 | GCAUUUGAAGAACAUGACUNN | 3679 |
| 687-705 | GUCAUGUUCUUCAAAUGCCNN | 2621 | GGCAUUUGAAGAACAUGACNN | 3680 |
| 688-706 | UCAUGUUCUUCAAAUGCCCNN | 2622 | GGGCAUUUGAAGAACAUGANN | 3681 |
| 689-707 | CAUGUUCUUCAAAUGCCCUNN | 2623 | AGGGCAUUUGAAGAACAUGNN | 3682 |
| 690-708 | AUGUUCUUCAAAUGCCCUUNN | 2624 | AAGGGCAUUUGAAGAACAUNN | 3683 |
| 691-709 | UGUUCUUCAAAUGCCCUUCNN | 2625 | GAAGGGCAUUUGAAGAACANN | 3684 |
| 692-710 | GUUCUUCAAAUGCCCUUCCNN | 2626 | GGAAGGGCAUUUGAAGAACNN | 3685 |
| 693-711 | UUCUUCAAAUGCCCUUCCCNN | 2627 | GGGAAGGGCAUUUGAAGAANN | 3686 |
| 694-712 | UCUUCAAAUGCCCUUCCCCNN | 2628 | GGGGAAGGGCAUUUGAAGANN | 3687 |
| 695-713 | CUUCAAAUGCCCUUCCCCANN | 2629 | UGGGGAAGGGCAUUUGAAGNN | 3688 |
| 696-714 | UUCAAAUGCCCUUCCCCAGNN | 2630 | CUGGGGAAGGGCAUUUGAANN | 3689 |
| 697-715 | UCAAAUGCCCUUCCCCAGANN | 2631 | UCUGGGGAAGGGCAUUUGANN | 3690 |
| 698-716 | CAAAUGCCCUUCCCCAGAGNN | 2632 | CUCUGGGGAAGGGCAUUUGNN | 3691 |
| 718-736 | CUGCCAGCCUGGAGGAGCUNN | 2633 | AGCUCCUCCAGGCUGGCAGNN | 3692 |
| 719-737 | UGCCAGCCUGGAGGAGCUCNN | 2634 | GAGCUCCUCCAGGCUGGCANN | 3693 |
| 720-738 | GCCAGCCUGGAGGAGCUCCNN | 2635 | GGAGCUCCUCCAGGCUGGCNN | 3694 |
| 721-739 | CCAGCCUGGAGGAGCUCCCNN | 2636 | GGGAGCUCCUCCAGGCUGGNN | 3695 |
| 722-740 | CAGCCUGGAGGAGCUCCCANN | 2637 | UGGGAGCUCCUCCAGGCUGNN | 3696 |
| 723-741 | AGCCUGGAGGAGCUCCCAGNN | 2638 | CUGGGAGCUCCUCCAGGCUNN | 3697 |
| 724-742 | GCCUGGAGGAGCUCCCAGANN | 2639 | UCUGGGAGCUCCUCCAGGCNN | 3698 |
| 725-743 | CCUGGAGGAGCUCCCAGAGNN | 2640 | CUCUGGGAGCUCCUCCAGGNN | 3699 |
| 726-744 | CUGGAGGAGCUCCCAGAGGNN | 2641 | CCUCUGGGAGCUCCUCCAGNN | 3700 |
| 727-745 | UGGAGGAGCUCCCAGAGGUNN | 2642 | ACCUCUGGGAGCUCCUCCANN | 3701 |
| 728-746 | GGAGGAGCUCCCAGAGGUCNN | 2643 | GACCUCUGGGAGCUCCUCCNN | 3702 |
| 729-747 | GAGGAGCUCCCAGAGGUCUNN | 2644 | AGACCUCUGGGAGCUCCUCNN | 3703 |
| 730-748 | AGGAGCUCCCAGAGGUCUANN | 2645 | UAGACCUCUGGGAGCUCCUNN | 3704 |
| 731-749 | GGAGCUCCCAGAGGUCUACNN | 2646 | GUAGACCUCUGGGAGCUCCNN | 3705 |
| 732-750 | GAGCUCCCAGAGGUCUACCNN | 2647 | GGUAGACCUCUGGGAGCUCNN | 3706 |
| 733-751 | AGCUCCCAGAGGUCUACCCNN | 2648 | GGGUAGACCUCUGGGAGCUNN | 3707 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 734-752 | GCUCCCAGAGGUCUACCCANN | 2649 | UGGGUAGACCUCUGGGAGCNN | 3708 |
| 735-753 | CUCCCAGAGGUCUACCCAGNN | 2650 | CUGGGUAGACCUCUGGGAGNN | 3709 |
| 736-754 | UCCCAGAGGUCUACCCAGANN | 2651 | UCUGGGUAGACCUCUGGGANN | 3710 |
| 737-755 | CCCAGAGGUCUACCCAGAANN | 2652 | UUCUGGGUAGACCUCUGGGNN | 3711 |
| 738-756 | CCAGAGGUCUACCCAGAAGNN | 2653 | CUUCUGGGUAGACCUCUGGNN | 3712 |
| 739-757 | CAGAGGUCUACCCAGAAGGNN | 2654 | CCUUCUGGGUAGACCUCUGNN | 3713 |
| 740-758 | AGAGGUCUACCCAGAAGGANN | 2655 | UCCUUCUGGGUAGACCUCUNN | 3714 |
| 741-759 | GAGGUCUACCCAGAAGGACNN | 2656 | GUCCUUCUGGGUAGACCUCNN | 3715 |
| 742-760 | AGGUCUACCCAGAAGGACCNN | 2657 | GGUCCUUCUGGGUAGACCUNN | 3716 |
| 743-761 | GGUCUACCCAGAAGGACCCNN | 2658 | GGGUCCUUCUGGGUAGACCNN | 3717 |
| 744-762 | GUCUACCCAGAAGGACCCANN | 2659 | UGGGUCCUUCUGGGUAGACNN | 3718 |
| 745-763 | UCUACCCAGAAGGACCCAGNN | 2660 | CUGGGUCCUUCUGGGUAGANN | 3719 |
| 746-764 | CUACCCAGAAGGACCCAGUNN | 2661 | ACUGGGUCCUUCUGGGUAGNN | 3720 |
| 747-765 | UACCCAGAAGGACCCAGUUNN | 2662 | AACUGGGUCCUUCUGGGUANN | 3721 |
| 748-766 | ACCCAGAAGGACCCAGUUCNN | 2663 | GAACUGGGUCCUUCUGGGUNN | 3722 |
| 749-767 | CCCAGAAGGACCCAGUUCCNN | 2664 | GGAACUGGGUCCUUCUGGGNN | 3723 |
| 750-768 | CCAGAAGGACCCAGUUCCUNN | 2665 | AGGAACUGGGUCCUUCUGGNN | 3724 |
| 751-769 | CAGAAGGACCCAGUUCCUUNN | 2666 | AAGGAACUGGGUCCUUCUGNN | 3725 |
| 752-770 | AGAAGGACCCAGUUCCUUANN | 2667 | UAAGGAACUGGGUCCUUCUNN | 3726 |
| 753-771 | GAAGGACCCAGUUCCUUACNN | 2668 | GUAAGGAACUGGGUCCUUCNN | 3727 |
| 754-772 | AAGGACCCAGUUCCUUACCNN | 2669 | GGUAAGGAACUGGGUCCUUNN | 3728 |
| 755-773 | AGGACCCAGUUCCUUACCANN | 2670 | UGGUAAGGAACUGGGUCCUNN | 3729 |
| 756-774 | GGACCCAGUUCCUUACCAGNN | 2671 | CUGGUAAGGAACUGGGUCCNN | 3730 |
| 757-775 | GACCCAGUUCCUUACCAGCNN | 2672 | GCUGGUAAGGAACUGGGUCNN | 3731 |
| 758-776 | ACCCAGUUCCUUACCAGCCNN | 2673 | GGCUGGUAAGGAACUGGGUNN | 3732 |
| 759-777 | CCCAGUUCCUUACCAGCCUNN | 2674 | AGGCUGGUAAGGAACUGGGNN | 3733 |
| 760-778 | CCAGUUCCUUACCAGCCUCNN | 2675 | GAGGCUGGUAAGGAACUGGNN | 3734 |
| 761-779 | CAGUUCCUUACCAGCCUCCNN | 2676 | GGAGGCUGGUAAGGAACUGNN | 3735 |
| 762-780 | AGUUCCUUACCAGCCUCCCNN | 2677 | GGGAGGCUGGUAAGGAACUNN | 3736 |
| 763-781 | GUUCCUUACCAGCCUCCCUNN | 2678 | AGGGAGGCUGGUAAGGAACNN | 3737 |
| 764-782 | UUCCUUACCAGCCUCCCUUNN | 2679 | AAGGGAGGCUGGUAAGGAANN | 3738 |
| 765-783 | UCCUUACCAGCCUCCCUUUNN | 2680 | AAAGGGAGGCUGGUAAGGANN | 3739 |
| 766-784 | CCUUACCAGCCUCCCUUUCNN | 2681 | GAAAGGGAGGCUGGUAAGGNN | 3740 |
| 767-785 | CUUACCAGCCUCCCUUUCUNN | 2682 | AGAAAGGGAGGCUGGUAAGNN | 3741 |
| 768-786 | UUACCAGCCUCCCUUUCUCNN | 2683 | GAGAAAGGGAGGCUGGUAANN | 3742 |
| 769-787 | UACCAGCCUCCCUUUCUCUNN | 2684 | AGAGAAAGGGAGGCUGGUANN | 3743 |
| 770-788 | ACCAGCCUCCCUUUCUCUGNN | 2685 | CAGAGAAAGGGCGGCUGGUNN | 3744 |
| 771-789 | CCAGCCUCCCUUUCUCUGUNN | 2686 | ACAGAGAAAGGGAGGCUGGNN | 3745 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 772-790 | CAGCCUCCCUUUCUCUGUCNN | 2687 | GACAGAGAAAGGGAGGCUGNN | 3746 |
| 773-791 | AGCCUCCCUUUCUCUGUCANN | 2688 | UGACAGAGAAAGGGAGGCUNN | 3747 |
| 774-792 | GCCUCCCUUUCUCUGUCAGNN | 2689 | CUGACAGAGAAAGGGAGGCNN | 3748 |
| 775-793 | CCUCCCUUUCUCUGUCAGUNN | 2690 | ACUGACAGAGAAAGGGAGGNN | 3749 |
| 776-794 | CUCCCUUUCUCUGUCAGUGNN | 2691 | CACUGACAGAGAAAGGGAGNN | 3750 |
| 777-795 | UCCCUUUCUCUGUCAGUGGNN | 2692 | CCACUGACAGAGAAAGGGANN | 3751 |
| 778-796 | CCCUUUCUCUGUCAGUGGGNN | 2693 | CCCACUGACAGAGAAAGGGNN | 3752 |
| 779-797 | CCUUUCUCUGUCAGUGGGGNN | 2694 | CCCCACUGACAGAGAAAGGNN | 3753 |
| 780-798 | CUUUCUCUGUCAGUGGGGANN | 2695 | UCCCCACUGACAGAGAAAGNN | 3754 |
| 781-799 | UUUCUCUGUCAGUGGGGACNN | 2696 | GUCCCCACUGACAGAGAAANN | 3755 |
| 782-800 | UUCUCUGUCAGUGGGGACGNN | 2697 | CGUCCCCACUGACAGAGAANN | 3756 |
| 783-801 | UCUCUGUCAGUGGGGACGUNN | 2698 | ACGUCCCCACUGACAGAGANN | 3757 |
| 784-802 | CUCUGUCAGUGGGGACGUCNN | 2699 | GACGUCCCCACUGACAGAGNN | 3758 |
| 785-803 | UCUGUCAGUGGGGACGUCANN | 2700 | UGACGUCCCCACUGACAGANN | 3759 |
| 786-804 | CUGUCAGUGGGGACGUCAUNN | 2701 | AUGACGUCCCCACUGACAGNN | 3760 |
| 787-805 | UGUCAGUGGGGACGUCAUCNN | 2702 | GAUGACGUCCCCACUGACANN | 3761 |
| 788-806 | GUCAGUGGGGACGUCAUCANN | 2703 | UGAUGACGUCCCCACUGACNN | 3762 |
| 789-807 | UCAGUGGGGACGUCAUCAGNN | 2704 | CUGAUGACGUCCCCACUGANN | 3763 |
| 790-808 | CAGUGGGGACGUCAUCAGCNN | 2705 | GCUGAUGACGUCCCCACUGNN | 3764 |
| 791-809 | AGUGGGGACGUCAUCAGCCNN | 2706 | GGCUGAUGACGUCCCCACUNN | 3765 |
| 792-810 | GUGGGGACGUCAUCAGCCANN | 2707 | UGGCUGAUGACGUCCCCACNN | 3766 |
| 793-811 | UGGGGACGUCAUCAGCCAANN | 2708 | UUGGCUGAUGACGUCCCCANN | 3767 |
| 794-812 | GGGGACGUCAUCAGCCAAGNN | 2709 | CUUGGCUGAUGACGUCCCCNN | 3768 |
| 795-813 | GGGACGUCAUCAGCCAAGCNN | 2710 | GCUUGGCUGAUGACGUCCCNN | 3769 |
| 796-814 | GGACGUCAUCAGCCAAGCUNN | 2711 | AGCUUGGCUGAUGACGUCCNN | 3770 |
| 797-815 | GACGUCAUCAGCCAAGCUGNN | 2712 | CAGCUUGGCUGAUGACGUCNN | 3771 |
| 798-816 | ACGUCAUCAGCCAAGCUGGNN | 2713 | CCAGCUUGGCUGAUGACGUNN | 3772 |
| 799-817 | CGUCAUCAGCCAAGCUGGANN | 2714 | UCCAGCUUGGCUGAUGACGNN | 3773 |
| 800-818 | GUCAUCAGCCAAGCUGGAANN | 2715 | UUCCAGCUUGGCUGAUGACNN | 3774 |
| 801-819 | UCAUCAGCCAAGCUGGAAGNN | 2716 | CUUCCAGCUUGGCUGAUGANN | 3775 |
| 802-820 | CAUCAGCCAAGCUGGAAGCNN | 2717 | GCUUCCAGCUUGGCUGAUGNN | 3776 |
| 803-821 | AUCAGCCAAGCUGGAAGCCNN | 2718 | GGCUUCCAGCUUGGCUGAUNN | 3777 |
| 804-822 | UCAGCCAAGCUGGAAGCCANN | 2719 | UGGCUUCCAGCUUGGCUGANN | 3778 |
| 805-823 | CAGCCAAGCUGGAAGCCAUNN | 2720 | AUGGCUUCCAGCUUGGCUGNN | 3779 |
| 806-824 | AGCCAAGCUGGAAGCCAUUNN | 2721 | AAUGGCUUCCAGCUUGGCUNN | 3780 |
| 807-825 | GCCAAGCUGGAAGCCAUUANN | 2722 | UAAUGGCUUCCAGCUUGGCNN | 3781 |
| 808-826 | CCAAGCUGGAAGCCAUUAANN | 2723 | UUAAUGGCUUCCAGCUUGGNN | 3782 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 809-827 | CAAGCUGGAAGCCAUUAAUNN | 2724 | AUUAAUGGCUUCCAGCUUGNN | 3783 |
| 810-828 | AAGCUGGAAGCCAUUAAUGNN | 2725 | CAUUAAUGGCUUCCAGCUUNN | 3784 |
| 811-829 | AGCUGGAAGCCAUUAAUGANN | 2726 | UCAUUAAUGGCUUCCAGCUNN | 3785 |
| 812-830 | GCUGGAAGCCAUUAAUGAANN | 2727 | UUCAUUAAUGGCUUCCAGCNN | 3786 |
| 813-831 | CUGGAAGCCAUUAAUGAACNN | 2728 | GUUCAUUAAUGGCUUCCAGNN | 3787 |
| 814-832 | UGGAAGCCAUUAAUGAACUNN | 2729 | AGUUCAUUAAUGGCUUCCANN | 3788 |
| 815-833 | GGAAGCCAUUAAUGAACUANN | 2730 | UAGUUCAUUAAUGGCUUCCNN | 3789 |
| 816-834 | GAAGCCAUUAAUGAACUAANN | 2731 | UUAGUUCAUUAAUGGCUUCNN | 3790 |
| 817-835 | AAGCCAUUAAUGAACUAAUNN | 2732 | AUUAGUUCAUUAAUGGCUUNN | 3791 |
| 818-836 | AGCCAUUAAUGAACUAAUUNN | 2733 | AAUUAGUUCAUUAAUGGCUNN | 3792 |
| 819-837 | GCCAUUAAUGAACUAAUUCNN | 2734 | GAAUUAGUUCAUUAAUGGCNN | 3793 |
| 820-838 | CCAUUAAUGAACUAAUUCGNN | 2735 | CGAAUUAGUUCAUUAAUGGNN | 3794 |
| 821-839 | CAUUAAUGAACUAAUUCGUNN | 2736 | ACGAAUUAGUUCAUUAAUGNN | 3795 |
| 822-840 | AUUAAUGAACUAAUUCGUUNN | 2737 | AACGAAUUAGUUCAUUAAUNN | 3796 |
| 823-841 | UUAAUGAACUAAUUCGUUUNN | 2738 | AAACGAAUUAGUUCAUUAANN | 3797 |
| 824-842 | UAAUGAACUAAUUCGUUUUNN | 2739 | AAAACGAAUUAGUUCAUUANN | 3798 |
| 825-843 | AAUGAACUAAUUCGUUUUGNN | 2740 | CAAAACGAAUUAGUUCAUUNN | 3799 |
| 826-844 | AUGAACUAAUUCGUUUUGANN | 2741 | UCAAAACGAAUUAGUUCAUNN | 3800 |
| 827-845 | UGAACUAAUUCGUUUUGACNN | 2742 | GUCAAAACGAAUUAGUUCANN | 3801 |
| 828-846 | GAACUAAUUCGUUUUGACCNN | 2743 | GGUCAAAACGAAUUAGUUCNN | 3802 |
| 829-847 | AACUAAUUCGUUUUGACCANN | 2744 | UGGUCAAAACGAAUUAGUUNN | 3803 |
| 830-848 | ACUAAUUCGUUUUGACCACNN | 2745 | GUGGUCAAAACGAAUUAGUNN | 3804 |
| 831-849 | CUAAUUCGUUUUGACCACANN | 2746 | UGUGGUCAAAACGAAUUAGNN | 3805 |
| 832-850 | UAAUUCGUUUUGACCACAUNN | 2747 | AUGUGGUCAAAACGAAUUANN | 3806 |
| 833-851 | AAUUCGUUUUGACCACAUANN | 2748 | UAUGUGGUCAAAACGAAUUNN | 3807 |
| 834-852 | AUUCGUUUUGACCACAUAUNN | 2749 | AUAUGUGGUCAAAACGAAUNN | 3808 |
| 835-853 | UUCGUUUUGACCACAUAUANN | 2750 | UAUAUGUGGUCAAAACGAANN | 3809 |
| 836-854 | UCGUUUUGACCACAUAUAUNN | 2751 | AUAUAUGUGGUCAAAACGANN | 3810 |
| 837-855 | CGUUUUGACCACAUAUAUANN | 2752 | UAUAUAUGUGGUCAAAACGNN | 3811 |
| 838-856 | GUUUUGACCACAUAUAUACNN | 2753 | GUAUAUAUGUGGUCAAAACNN | 3812 |
| 839-857 | UUUUGACCACAUAUAUACCNN | 2754 | GGUAUAUAUGUGGUCAAAANN | 3813 |
| 840-858 | UUUGACCACAUAUAUACCANN | 2755 | UGGUAUAUAUGUGGUCAAANN | 3814 |
| 841-859 | UUGACCACAUAUAUACCAANN | 2756 | UUGGUAUAUAUGUGGUCANN | 3815 |
| 842-860 | UGACCACAUAUAUACCAAGNN | 2757 | CUUGGUAUAUAUGUGGUCANN | 3816 |
| 843-861 | GACCACAUAUAUACCAAGCNN | 2758 | GCUUGGUAUAUAUGUGGUCNN | 3817 |
| 844-862 | ACCACAUAUAUACCAAGCCNN | 2759 | GGCUUGGUAUAUAUGUGGUNN | 3818 |
| 845-863 | CCACAUAUAUACCAAGCCCNN | 2760 | GGGCUUGGUAUAUAUGUGGNN | 3819 |
| 846-864 | CACAUAUAUACCAAGCCCCNN | 2761 | GGGGCUUGGUAUAUAUGUGNN | 3820 |

TABLE 12 -continued

Sequences of dsRNA targeting both human and rhesus monkeyXBP-1.

| Target* | sense (5'-3') | SEQ ID NO | antisense (5'-3') | SEQ ID NO |
|---|---|---|---|---|
| 847-865 | ACAUAUAUACCAAGCCCCUNN | 2762 | AGGGGCUUGGUAUAUAUGUNN | 3821 |
| 867-885 | GUCUUAGAGAUACCCUCUGNN | 2763 | CAGAGGGUAUCUCUAAGACNN | 3822 |
| 868-886 | UCUUAGAGAUACCCUCUGANN | 2764 | UCAGAGGGUAUCUCUAAGANN | 3823 |
| 869-887 | CUUAGAGAUACCCUCUGAGNN | 2765 | CUCAGAGGGUAUCUCUAAGNN | 3824 |
| 870-888 | UUAGAGAUACCCUCUGAGANN | 2766 | UCUCAGAGGGUAUCUCUAANN | 3825 |
| 871-889 | UAGAGAUACCCUCUGAGACNN | 2767 | GUCUCAGAGGGUAUCUCUANN | 3826 |
| 872-890 | AGAGAUACCCUCUGAGACANN | 2768 | UGUCUCAGAGGGUAUCUCUNN | 3827 |
| 873-891 | GAGAUACCCUCUGAGACAGNN | 2769 | CUGUCUCAGAGGGUAUCUCNN | 3828 |
| 874-892 | AGAUACCCUCUGAGACAGANN | 2770 | UCUGUCUCAGAGGGUAUCUNN | 3829 |
| 875-893 | GAUACCCUCUGAGACAGAGNN | 2771 | CUCUGUCUCAGAGGGUAUCNN | 3830 |
| 876-894 | AUACCCUCUGAGACAGAGANN | 2772 | UCUCUGUCUCAGAGGGUAUNN | 3831 |
| 877-895 | UACCCUCUGAGACAGAGAGNN | 2773 | CUCUCUGUCUCAGAGGGUANN | 3832 |
| 878-896 | ACCCUCUGAGACAGAGAGCNN | 2774 | GCUCUCUGUCUCAGAGGGUNN | 3833 |
| 879-897 | CCCUCUGAGACAGAGAGCCNN | 2775 | GGCUCUCUGUCUCAGAGGGNN | 3834 |
| 880-898 | CCUCUGAGACAGAGAGCCANN | 2776 | UGGCUCUCUGUCUCAGAGGNN | 3835 |
| 881-899 | CUCUGAGACAGAGAGCCAANN | 2777 | UUGGCUCUCUGUCUCAGAGNN | 3836 |
| 882-900 | UCUGAGACAGAGAGCCAAGNN | 2778 | CUUGGCUCUCUGUCUCAGANN | 3837 |
| 883-901 | CUGAGACAGAGAGCCAAGCNN | 2779 | GCUUGGCUCUCUGUCUCAGNN | 3838 |
| 884-902 | UGAGACAGAGAGCCAAGCUNN | 2780 | AGCUUGGCUCUCUGUCUCANN | 3839 |
| 885-903 | GAGACAGAGAGCCAAGCUANN | 2781 | UAGCUUGGCUCUCUGUCUCNN | 3840 |
| 886-904 | AGACAGAGAGCCAAGCUAANN | 2782 | UUAGCUUGGCUCUCUGUCUNN | 3841 |
| 887-905 | GACAGAGAGCCAAGCUAAUNN | 2783 | AUUAGCUUGGCUCUCUGUCNN | 3842 |
| 888-906 | ACAGAGAGCCAAGCUAAUGNN | 2784 | CAUUAGCUUGGCUCUCUGUNN | 3843 |
| 889-907 | CAGAGAGCCAAGCUAAUGUNN | 2785 | ACAUUAGCUUGGCUCUCUGNN | 3844 |
| 890-908 | AGAGAGCCAAGCUAAUGUGNN | 2786 | CACAUUAGCUUGGCUCUCUNN | 3845 |
| 891-909 | GAGAGCCAAGCUAAUGUGGNN | 2787 | CCACAUUAGCUUGGCUCUCNN | 3846 |
| 892-910 | AGAGCCAAGCUAAUGUGGUNN | 2788 | ACCACAUUAGCUUGGCUCUNN | 3847 |
| 893-911 | GAGCCAAGCUAAUGUGGUANN | 2789 | UACCACAUUAGCUUGGCUCNN | 3848 |
| 894-912 | AGCCAAGCUAAUGUGGUAGNN | 2790 | CUACCACAUUAGCUUGGCUNN | 3849 |
| 895-913 | GCCAAGCUAAUGUGGUAGUNN | 2791 | ACUACCACAUUAGCUUGGCNN | 3850 |
| 896-914 | CCAAGCUAAUGUGGUAGUGNN | 2792 | CACUACCACAUUAGCUUGGNN | 3851 |
| 897-915 | CAAGCUAAUGUGGUAGUGANN | 2793 | UCACUACCACAUUAGCUUGNN | 3852 |
| 898-916 | AAGCUAAUGUGGUAGUGAANN | 2794 | UUCACUACCACAUUAGCUUNN | 3853 |
| 899-917 | AGCUAAUGUGGUAGUGAAANN | 2795 | UUUCACUACCACAUUAGCUNN | 3854 |
| 900-918 | GCUAAUGUGGUAGUGAAAANN | 2796 | UUUUCACUACCACAUUAGCNN | 3855 |
| 901-919 | CUAAUGUGGUAGUGAAAAUNN | 2797 | AUUUUCACUACCACAUUAGNN | 3856 |
| 902-920 | UAAUGUGGUAGUGAAAAUCNN | 2798 | GAUUUUCACUACCACAUUANN | 3857 |

TABLE 12 -continued

Sequences of dsRNA targeting both human and rhesus monkeyXBP-1.

| Target* | sense (5'-3') | SEQ ID NO | antisense (5'-3') | SEQ ID NO |
|---|---|---|---|---|
| 903-921 | AAUGUGGUAGUGAAAAUCGNN | 2799 | CGAUUUUCACUACCACAUNN | 3858 |
| 904-922 | AUGUGGUAGUGAAAAUCGANN | 2800 | UCGAUUUUCACUACCACAUNN | 3859 |
| 905-923 | UGUGGUAGUGAAAAUCGAGNN | 2801 | CUCGAUUUUCACUACCACNN | 3860 |
| 906-924 | GUGGUAGUGAAAAUCGAGGNN | 2802 | CCUCGAUUUUCACUACCACNN | 3861 |
| 907-925 | UGGUAGUGAAAAUCGAGGANN | 2803 | UCCUCGAUUUUCACUACCNN | 3862 |
| 908-926 | GGUAGUGAAAAUCGAGGAANN | 2804 | UUCCUCGAUUUUCACUACCNN | 3863 |
| 909-927 | GUAGUGAAAAUCGAGGAAGNN | 2805 | CUUCCUCGAUUUUCACUACNN | 3864 |
| 910-928 | UAGUGAAAAUCGAGGAAGCNN | 2806 | GCUUCCUCGAUUUUCACUANN | 3865 |
| 911-929 | AGUGAAAAUCGAGGAAGCANN | 2807 | UGCUUCCUCGAUUUUCACUNN | 3866 |
| 912-930 | GUGAAAAUCGAGGAAGCACNN | 2808 | GUGCUUCCUCGAUUUUCACNN | 3867 |
| 913-931 | UGAAAAUCGAGGAAGCACCNN | 2809 | GGUGCUUCCUCGAUUUUCANN | 3868 |
| 914-932 | GAAAAUCGAGGAAGCACCUNN | 2810 | AGGUGCUUCCUCGAUUUUCNN | 3869 |
| 915-933 | AAAAUCGAGGAAGCACCUCNN | 2811 | GAGGUGCUUCCUCGAUUUUNN | 3870 |
| 916-934 | AAAUCGAGGAAGCACCUCUNN | 2812 | AGAGGUGCUUCCUCGAUUUNN | 3871 |
| 917-935 | AAUCGAGGAAGCACCUCUCNN | 2813 | GAGAGGUGCUUCCUCGAUUNN | 3872 |
| 918-936 | AUCGAGGAAGCACCUCUCANN | 2814 | UGAGAGGUGCUUCCUCGAUNN | 3873 |
| 919-937 | UCGAGGAAGCACCUCUCAGNN | 2815 | CUGAGAGGUGCUUCCUCGANN | 3874 |
| 920-938 | CGAGGAAGCACCUCUCAGCNN | 2816 | GCUGAGAGGUGCUUCCUCGNN | 3875 |
| 921-939 | GAGGAAGCACCUCUCAGCCNN | 2817 | GGCUGAGAGGUGCUUCCUCNN | 3876 |
| 922-940 | AGGAAGCACCUCUCAGCCCNN | 2818 | GGGCUGAGAGGUGCUUCCUNN | 3877 |
| 923-941 | GGAAGCACCUCUCAGCCCCNN | 2819 | GGGGCUGAGAGGUGCUUCCNN | 3878 |
| 924-942 | GAAGCACCUCUCAGCCCCUNN | 2820 | AGGGGCUGAGAGGUGCUUCNN | 3879 |
| 925-943 | AAGCACCUCUCAGCCCCUCNN | 2821 | GAGGGGCUGAGAGGUGCUUNN | 3880 |
| 926-944 | AGCACCUCUCAGCCCCUCANN | 2822 | UGAGGGGCUGAGAGGUGCUNN | 3881 |
| 927-945 | GCACCUCUCAGCCCCUCAGNN | 2823 | CUGAGGGGCUGAGAGGUGCNN | 3882 |
| 928-946 | CACCUCUCAGCCCCUCAGANN | 2824 | UCUGAGGGGCUGAGAGGUGNN | 3883 |
| 929-947 | ACCUCUCAGCCCCUCAGAGNN | 2825 | CUCUGAGGGGCUGAGAGGUNN | 3884 |
| 930-948 | CCUCUCAGCCCCUCAGAGANN | 2826 | UCUCUGAGGGGCUGAGAGGNN | 3885 |
| 931-949 | CUCUCAGCCCCUCAGAGAANN | 2827 | UUCUCUGAGGGGCUGAGAGNN | 3886 |
| 932-950 | UCUCAGCCCCUCAGAGAAUNN | 2828 | AUUCUCUGAGGGGCUGAGANN | 3887 |
| 933-951 | CUCAGCCCCUCAGAGAAUGNN | 2829 | CAUUCUCUGAGGGGCUGAGNN | 3888 |
| 934-952 | UCAGCCCCUCAGAGAAUGANN | 2830 | UCAUUCUCUGAGGGGCUGANN | 3889 |
| 935-953 | CAGCCCCUCAGAGAAUGAUNN | 2831 | AUCAUUCUCUGAGGGGCUGNN | 3890 |
| 936-954 | AGCCCCUCAGAGAAUGAUCNN | 2832 | GAUCAUUCUCUGAGGGGCUNN | 3891 |
| 937-955 | GCCCCUCAGAGAAUGAUCANN | 2833 | UGAUCAUUCUCUGAGGGGCNN | 3892 |
| 938-956 | CCCCUCAGAGAAUGAUCACNN | 2834 | GUGAUCAUUCUCUGAGGGGNN | 3893 |
| 939-957 | CCCUCAGAGAAUGAUCACCNN | 2835 | GGUGAUCAUUCUCUGAGGGNN | 3894 |
| 940-958 | CCUCAGAGAAUGAUCACCCNN | 2836 | GGGUGAUCAUUCUCUGAGGNN | 3895 |

TABLE 12 -continued

Sequences of dsRNA targeting both human and rhesus monkey XBP-1.

| Target* | sense (5'-3') | SEQ ID NO | antisense (5'-3') | SEQ ID NO |
|---|---|---|---|---|
| 941-959 | CUCAGAGAAUGAUCACCCUNN | 2837 | AGGGUGAUCAUUCUCUGAGNN | 3896 |
| 942-960 | UCAGAGAAUGAUCACCCUGNN | 2838 | CAGGGUGAUCAUUCUCUGANN | 3897 |
| 943-961 | CAGAGAAUGAUCACCCUGANN | 2839 | UCAGGGUGAUCAUUCUCUGNN | 3898 |
| 944-962 | AGAGAAUGAUCACCCUGAANN | 2840 | UUCAGGGUGAUCAUUCUCUNN | 3899 |
| 945-963 | GAGAAUGAUCACCCUGAAUNN | 2841 | AUUCAGGGUGAUCAUUCUCNN | 3900 |
| 946-964 | AGAAUGAUCACCCUGAAUUNN | 2842 | AAUUCAGGGUGAUCAUUCUNN | 3901 |
| 947-965 | GAAUGAUCACCCUGAAUUCNN | 2843 | GAAUUCAGGGUGAUCAUUCNN | 3902 |
| 948-966 | AAUGAUCACCCUGAAUUCANN | 2844 | UGAAUUCAGGGUGAUCAUUNN | 3903 |
| 949-967 | AUGAUCACCCUGAAUUCAUNN | 2845 | AUGAAUUCAGGGUGAUCAUNN | 3904 |
| 950-968 | UGAUCACCCUGAAUUCAUUNN | 2846 | AAUGAAUUCAGGGUGAUCANN | 3905 |
| 951-969 | GAUCACCCUGAAUUCAUUGNN | 2847 | CAAUGAAUUCAGGGUGAUCNN | 3906 |
| 952-970 | AUCACCCUGAAUUCAUUGUNN | 2848 | ACAAUGAAUUCAGGGUGAUNN | 3907 |
| 953-971 | UCACCCUGAAUUCAUUGUCNN | 2849 | GACAAUGAAUUCAGGGUGANN | 3908 |
| 954-972 | CACCCUGAAUUCAUUGUCUNN | 2850 | AGACAAUGAAUUCAGGGUGNN | 3909 |
| 955-973 | ACCCUGAAUUCAUUGUCUCNN | 2851 | GAGACAAUGAAUUCAGGGUNN | 3910 |
| 956-974 | CCCUGAAUUCAUUGUCUCANN | 2852 | UGAGACAAUGAAUUCAGGGNN | 3911 |
| 957-975 | CCUGAAUUCAUUGUCUCAGNN | 2853 | CUGAGACAAUGAAUUCAGGNN | 3912 |
| 958-976 | CUGAAUUCAUUGUCUCAGUNN | 2854 | ACUGAGACAAUGAAUUCAGNN | 3913 |
| 959-977 | UGAAUUCAUUGUCUCAGUGNN | 2855 | CACUGAGACAAUGAAUUCANN | 3914 |
| 960-978 | GAAUUCAUUGUCUCAGUGANN | 2856 | UCACUGAGACAAUGAAUUCNN | 3915 |
| 961-979 | AAUUCAUUGUCUCAGUGAANN | 2857 | UUCACUGAGACAAUGAAUUNN | 3916 |
| 962-980 | AUUCAUUGUCUCAGUGAAGNN | 2858 | CUUCACUGAGACAAUGAAUNN | 3917 |
| 963-981 | UUCAUUGUCUCAGUGAAGGNN | 2859 | CCUUCACUGAGACAAUGAANN | 3918 |
| 964-982 | UCAUUGUCUCAGUGAAGGANN | 2860 | UCCUUCACUGAGACAAUGANN | 3919 |
| 965-983 | CAUUGUCUCAGUGAAGGAANN | 2861 | UUCCUUCACUGAGACAAUGNN | 3920 |
| 966-984 | AUUGUCUCAGUGAAGGAAGNN | 2862 | CUUCCUUCACUGAGACAAUNN | 3921 |
| 967-985 | UUGUCUCAGUGAAGGAAGANN | 2863 | UCUUCCUUCACUGAGACAANN | 3922 |
| 968-986 | UGUCUCAGUGAAGGAAGAANN | 2864 | UUCUUCCUUCACUGAGACANN | 3923 |
| 969-987 | GUCUCAGUGAAGGAAGAACNN | 2865 | GUUCUUCCUUCACUGAGACNN | 3924 |
| 970-988 | UCUCAGUGAAGGAAGAACCNN | 2866 | GGUUCUUCCUUCACUGAGANN | 3925 |
| 971-989 | CUCAGUGAAGGAAGAACCUNN | 2867 | AGGUUCUUCCUUCACUGAGNN | 3926 |
| 972-990 | UCAGUGAAGGAAGAACCUGNN | 2868 | CAGGUUCUUCCUUCACUGANN | 3927 |
| 973-991 | CAGUGAAGGAAGAACCUGUNN | 2869 | ACAGGUUCUUCCUUCACUGNN | 3928 |
| 974-992 | AGUGAAGGAAGAACCUGUANN | 2870 | UACAGGUUCUUCCUUCACUNN | 3929 |
| 975-993 | GUGAAGGAAGAACCUGUAGNN | 2871 | CUACAGGUUCUUCCUUCACNN | 3930 |
| 976-994 | UGAAGGAAGAACCUGUAGANN | 2872 | UCUACAGGUUCUUCCUUCANN | 3931 |
| 977-995 | GAAGGAAGAACCUGUAGAANN | 2873 | UUCUACAGGUUCUUCCUUCNN | 3932 |

TABLE 12 -continued

Sequences of dsRNA targeting both human and rhesus monkeyXBP-1.

| Target* | sense (5'-3') | SEQ ID NO | antisense (5'-3') | SEQ ID NO |
|---|---|---|---|---|
| 978-996 | AAGGAAGAACCUGUAGAAGNN | 2874 | CUUCUACAGGUUCUUCCUUNN | 3933 |
| 979-997 | AGGAAGAACCUGUAGAAGANN | 2875 | UCUUCUACAGGUUCUUCCUNN | 3934 |
| 980-998 | GGAAGAACCUGUAGAAGAUNN | 2876 | AUCUUCUACAGGUUCUUCCNN | 3935 |
| 981-999 | GAAGAACCUGUAGAAGAUGNN | 2877 | CAUCUUCUACAGGUUCUUCNN | 3936 |
| 982-1000 | AAGAACCUGUAGAAGAUGANN | 2878 | UCAUCUUCUACAGGUUCUUNN | 3937 |
| 983-1001 | AGAACCUGUAGAAGAUGACNN | 2879 | GUCAUCUUCUACAGGUUCUNN | 3938 |
| 984-1002 | GAACCUGUAGAAGAUGACCNN | 2880 | GGUCAUCUUCUACAGGUUCNN | 3939 |
| 985-1003 | AACCUGUAGAAGAUGACCUNN | 2881 | AGGUCAUCUUCUACAGGUUNN | 3940 |
| 986-1004 | ACCUGUAGAAGAUGACCUCNN | 2882 | GAGGUCAUCUUCUACAGGUNN | 3941 |

*Target refers location of target sequence in NM_005080 (human XBP-1 mRNA).
Sense and antisense sequences are described with optional dinucleotide (NN) overhangs.

TABLE 13

Sequences of dsRNA targeting both mouse and rhesus monkeyXBP-1.

| *Target | sense (5'-3') | SEQ ID NO | antisense (5'-3') | SEQ ID NO |
|---|---|---|---|---|
| 369-387 | AGAAAACUCACGGCCUUGUNN | 3942 | ACAAGGCCGUGAGUUUUCUNN | 4042 |
| 237-255 | AACUGAAAACAGAGUAGCNN | 3943 | GCUACUCUGUUUUCAGUUNN | 4043 |
| 491-509 | GGGUCUGCUGAGUCCGCAGNN | 3944 | CUGCGGACUCAGCAGACCCNN | 4044 |
| 917-935 | AUCACCCUGAAUUCAUUGUNN | 3945 | ACAAUGAAUUCAGGGUGAUNN | 4045 |
| 923-941 | CUGAAUUCAUUGUCUCAGUNN | 3946 | ACUGAGACAAUGAAUUCAGNN | 4046 |
| 702-720 | CCCAGAGGUCUACCCAGAANN | 3947 | UUCUGGGUAGACCUCUGGGNN | 4047 |
| 926-944 | AAUUCAUUGUCUCAGUGAANN | 3948 | UUCACUGAGACAAUGAAUUNN | 4048 |
| 391-409 | UGAGAACCAGGAGUUAAGANN | 3949 | UCUUAACUCCUGGUUCUCANN | 4049 |
| 775-793 | AAGCUGGAAGCCAUUAAUGNN | 3950 | CAUUAAUGGCUUCCAGCUUNN | 4050 |
| 1150-1168 | CCCCAGCUGAUUAGUGUCUNN | 3951 | AGACACUAAUCAGCUGGGGNN | 4051 |
| 776-794 | AGCUGGAAGCCAUUAAUGANN | 3952 | UCAUUAAUGGCUUCCAGCUNN | 4052 |
| 921-939 | CCCUGAAUUCAUUGUCUCANN | 3953 | UGAGACAAUGAAUUCAGGGNN | 4053 |
| 777-795 | GCUGGAAGCCAUUAAUGAANN | 3954 | UUCAUUAAUGGCUUCCAGCNN | 4054 |
| 539-557 | GUGCAGGCCCAGUUGUCACNN | 3955 | GUGACAACUGGGCCUGCACNN | 4055 |
| 731-749 | CCUUACCAGCCUCCCUUUCNN | 3956 | GAAAGGGAGGCUGGUAAGGNN | 4056 |
| 924-942 | UGAAUUCAUUGUCUCAGUGNN | 3957 | CACUGAGACAAUGAAUUCANN | 4057 |
| 1151-1169 | CCCAGCUGAUUAGUGUCUANN | 3958 | UAGACACUAAUCAGCUGGGNN | 4058 |
| 1152-1170 | CCAGCUGAUUAGUGUCUAANN | 3959 | UUAGACACUAAUCAGCUGGNN | 4059 |
| 1718-1736 | ACUAUGUAAAUGCUUGAUGNN | 3960 | CAUCAAGCAUUUACAUAGUNN | 4060 |
| 368-386 | GAGAAAACUCACGGCCUUGNN | 3961 | CAAGGCCGUGAGUUUUCUCNN | 4061 |
| 489-507 | CCGGGUCUGCUGAGUCCGCNN | 3962 | GCGGACUCAGCAGACCCGGNN | 4062 |
| 238-256 | ACUGAAAACAGAGUAGCANN | 3963 | UGCUACUCUGUUUUCAGUNN | 4063 |
| 240-258 | UGAAAACAGAGUAGCAGCNN | 3964 | GCUGCUACUCUGUUUUCANN | 4064 |

TABLE 13-continued

Sequences of dsRNA targeting both mouse and rhesus monkey XBP-1.

| *Target | sense (5'-3') | SEQ ID NO | antisense (5'-3') | SEQ ID NO |
|---|---|---|---|---|
| 390-408 | UUGAGAACCAGGAGUUAAGNN | 3965 | CUUAACUCCUGGUUCUCAANN | 4065 |
| 487-505 | GGCCGGGUCUGCUGAGUCCNN | 3966 | GGACUCAGCAGACCCGGCCNN | 4066 |
| 741-759 | CUCCCUUUCUCUGUCAGUGNN | 3967 | CACUGACAGAGAAAGGGAGNN | 4067 |
| 918-936 | UCACCCUGAAUUCAUUGUCNN | 3968 | GACAAUGAAUUCAGGGUGANN | 4068 |
| 919-937 | CACCCUGAAUUCAUUGUCUNN | 3969 | AGACAAUGAAUUCAGGGUGNN | 4069 |
| 1130-1148 | CUUUUGCCAAUGAACUUUUNN | 3970 | AAAAGUUCAUUGGCAAAAGNN | 4070 |
| 1712-1730 | AAAUUUACUAUGUAAAUGCNN | 3971 | GCAUUUACAUAGUAAAUUUNN | 4071 |
| 1714-1732 | AUUUACUAUGUAAAUGCUUNN | 3972 | AAGCAUUUACAUAGUAAAUNN | 4072 |
| 1717-1735 | UACUAUGUAAAUGCUUGAUNN | 3973 | AUCAAGCAUUUACAUAGUANN | 4073 |
| 1719-1737 | CUAUGUAAAUGCUUGAUGGNN | 3974 | CCAUCAAGCAUUUACAUAGNN | 4074 |
| 1775-1793 | CCAUUUAUUUAAAACUACCNN | 3975 | GGUAGUUUUAAAUAAAUGGNN | 4075 |
| 1776-1794 | CAUUUAUUUAAAACUACCCNN | 3976 | GGGUAGUUUUAAAUAAAUGNN | 4076 |
| 239-257 | CUGAAAAACAGAGUAGCAGNN | 3977 | CUGCUACUCUGUUUUUCAGNN | 4077 |
| 347-365 | CUAGAAAAUCAGCUUUUACNN | 3978 | GUAAAAGCUGAUUUUCUAGNN | 4078 |
| 348-366 | UAGAAAAUCAGCUUUUACGNN | 3979 | CGUAAAAGCUGAUUUUCUANN | 4079 |
| 485-503 | GUGGCCGGGUCUGCUGAGUNN | 3980 | ACUCAGCAGACCCGGCCACNN | 4080 |
| 486-504 | UGGCCGGGUCUGCUGAGUCNN | 3981 | GACUCAGCAGACCCGGCCANN | 4081 |
| 488-506 | GCCGGGUCUGCUGAGUCCGNN | 3982 | CGGACUCAGCAGACCCGGCNN | 4082 |
| 540-558 | UGCAGGCCCAGUUGUCACCNN | 3983 | GGUGACAACUGGGCCUGCANN | 4083 |
| 703-721 | CCAGAGGUCUACCCAGAAGNN | 3984 | CUUCUGGGUAGACCUCUGGNN | 4084 |
| 705-723 | AGAGGUCUACCCAGAAGGANN | 3985 | UCCUUCUGGGUAGACCUCUNN | 4085 |
| 730-748 | UCCUUACCAGCCUCCCUUUNN | 3986 | AAAGGGAGGCUGGUAAGGANN | 4086 |
| 742-760 | UCCCUUUCUCUGUCAGUGGNN | 3987 | CCACUGACAGAGAAAGGGANN | 4087 |
| 744-762 | CCUUUCUCUGUCAGUGGGGNN | 3988 | CCCCACUGACAGAGAAAGGNN | 4088 |
| 767-785 | CAUCAGCCAAGCUGGAAGCNN | 3989 | GCUUCCAGCUUGGCUGAUGNN | 4089 |
| 771-789 | AGCCAAGCUGGAAGCCAUUNN | 3990 | AAUGGCUUCCAGCUUGGCUNN | 4090 |
| 916-934 | GAUCACCCUGAAUUCAUUGNN | 3991 | CAAUGAAUUCAGGGUGAUCNN | 4091 |
| 920-938 | ACCCUGAAUUCAUUGUCUCNN | 3992 | GAGACAAUGAAUUCAGGGUNN | 4092 |
| 922-940 | CCUGAAUUCAUUGUCUCAGNN | 3993 | CUGAGACAAUGAAUUCAGGNN | 4093 |
| 925-943 | GAAUUCAUUGUCUCAGUGANN | 3994 | UCACUGAGACAAUGAAUUCNN | 4094 |
| 1720-1738 | UAUGUAAAUGCUUGAUGGANN | 3995 | UCCAUCAAGCAUUUACAUANN | 4095 |
| 232-250 | GAGGAAACUGAAAAACAGANN | 3996 | UCUGUUUUUCAGUUUCCUCNN | 4096 |
| 236-254 | AAACUGAAAAACAGAGUAGNN | 3997 | CUACUCUGUUUUUCAGUUUNN | 4097 |
| 728-746 | GUUCCUUACCAGCCUCCCUNN | 3998 | AGGGAGGCUGGUAAGGAACNN | 4098 |
| 729-747 | UUCCUUACCAGCCUCCCUUNN | 3999 | AAGGGAGGCUGGUAAGGAANN | 4099 |
| 745-763 | CUUUCUCUGUCAGUGGGGANN | 4000 | UCCCCACUGACAGAGAAAGNN | 4100 |
| 766-784 | UCAUCAGCCAAGCUGGAAGNN | 4001 | CUUCCAGCUUGGCUGAUGANN | 4101 |

TABLE 13-continued

Sequences of dsRNA targeting both mouse and rhesus monkey XBP-1.

| *Target | sense (5'-3') | SEQ ID NO | antisense (5'-3') | SEQ ID NO |
|---|---|---|---|---|
| 927-945 | AUUCAUUGUCUCAGUGAAGNN | 4002 | CUUCACUGAGACAAUGAAUNN | 4102 |
| 234-252 | GGAAACUGAAAAACAGAGUNN | 4003 | ACUCUGUUUUUCAGUUUCCNN | 4103 |
| 235-253 | GAAACUGAAAAACAGAGUANN | 4004 | UACUCUGUUUUUCAGUUUCNN | 4104 |
| 346-364 | GCUAGAAAAUCAGCUUUUANN | 4005 | UAAAAGCUGAUUUUCUAGCNN | 4105 |
| 490-508 | CGGGUCUGCUGAGUCCGCANN | 4006 | UGCGGACUCAGCAGACCCGNN | 4106 |
| 700-718 | CUCCCAGAGGUCUACCCAGNN | 4007 | CUGGGUAGACCUCUGGGAGNN | 4107 |
| 1715-1733 | UUUACUAUGUAAAUGCUUGNN | 4008 | CAAGCAUUUACAUAGUAAANN | 4108 |
| 734-752 | UACCAGCCUCCCUUUCUCUNN | 4009 | AGAGAAAGGGAGGCUGGUANN | 4109 |
| 773-791 | CCAAGCUGGAAGCCAUUAANN | 4010 | UUAAUGGCUUCCAGCUUGGNN | 4110 |
| 778-796 | CUGGAAGCCAUUAAUGAACNN | 4011 | GUUCAUUAAUGGCUUCCAGNN | 4111 |
| 779-797 | UGGAAGCCAUUAAUGAACUNN | 4012 | AGUUCAUUAAUGGCUUCCANN | 4112 |
| 1774-1792 | UCCAUUUAUUUAAAACUACNN | 4013 | GUAGUUUUAAAUAAAUGGANN | 4113 |
| 704-722 | CAGAGGUCUACCCAGAAGGNN | 4014 | CCUUCUGGGUAGACCUCUGNN | 4114 |
| 1716-1734 | UUACUAUGUAAAUGCUUGANN | 4015 | UCAAGCAUUUACAUAGUAANN | 4115 |
| 1713-1731 | AAUUUACUAUGUAAAUGCUNN | 4016 | AGCAUUUACAUAGUAAAUUNN | 4116 |
| 768-786 | AUCAGCCAAGCUGGAAGCCNN | 4017 | GGCUUCCAGCUUGGCUGAUNN | 4117 |
| 1129-1147 | ACUUUGCCAAUGAACUUUNN | 4018 | AAAGUUCAUUGGCAAAAGUNN | 4118 |
| 389-407 | GUUGAGAACCAGGAGUUAANN | 4019 | UUAACUCCUGGUUCUCAACNN | 4119 |
| 701-719 | UCCCAGAGGUCUACCCAGANN | 4020 | UCUGGGUAGACCUCUGGGANN | 4120 |
| 706-724 | GAGGUCUACCCAGAAGGACNN | 4021 | GUCCUUCUGGGUAGACCUCNN | 4121 |
| 707-725 | AGGUCUACCCAGAAGGACCNN | 4022 | GGUCCUUCUGGGUAGACCUNN | 4122 |
| 727-745 | AGUUCCUUACCAGCCUCCCNN | 4023 | GGGAGGCUGGUAAGGAACUNN | 4123 |
| 733-751 | UUACCAGCCUCCCUUUCUCNN | 4024 | GAGAAAGGGAGGCUGGUAANN | 4124 |
| 736-754 | CCAGCCUCCCUUUCUCUGUNN | 4025 | ACAGAGAAAGGGAGGCUGGNN | 4125 |
| 738-756 | AGCCUCCCUUUCUCUGUCANN | 4026 | UGACAGAGAAAGGGAGGCUNN | 4126 |
| 743-761 | CCCUUUCUCUGUCAGUGGGNN | 4027 | CCCACUGACAGAGAAAGGGNN | 4127 |
| 769-787 | UCAGCCAAGCUGGAAGCCANN | 4028 | UGGCUUCCAGCUUGGCUGANN | 4128 |
| 772-790 | GCCAAGCUGGAAGCCAUUANN | 4029 | UAAUGGCUUCCAGCUUGGCNN | 4129 |
| 774-792 | CAAGCUGGAAGCCAUUAAUNN | 4030 | AUUAAUGGCUUCCAGCUUGNN | 4130 |
| 231-249 | GGAGGAAACUGAAAAACAGNN | 4031 | CUGUUUUUCAGUUUCCUCCNN | 4131 |
| 233-251 | AGGAAACUGAAAAACAGAGNN | 4032 | CUCUGUUUUUCAGUUUCCUNN | 4132 |
| 735-753 | ACCAGCCUCCCUUUCUCUGNN | 4033 | CAGAGAAAGGGAGGCUGGUNN | 4133 |
| 737-755 | CAGCCUCCCUUUCUCUGUCNN | 4034 | GACAGAGAAAGGGAGGCUGNN | 4134 |
| 739-757 | GCCUCCCUUUCUCUGUCAGNN | 4035 | CUGACAGAGAAAGGGAGGCNN | 4135 |
| 740-758 | CCUCCCUUUCUCUGUCAGUNN | 4036 | ACUGACAGAGAAAGGGAGGNN | 4136 |
| 746-764 | UUUCUCUGUCAGUGGGGACNN | 4037 | GUCCCCACUGACAGAGAAANN | 4137 |
| 770-788 | CAGCCAAGCUGGAAGCCAUNN | 4038 | AUGGCUUCCAGCUUGGCUGNN | 4138 |
| 26-44 | GCUAUGGUGGUGGUGGCAGNN | 4039 | CUGCCACCACCACCAUAGCNN | 4139 |

TABLE 13-continued

Sequences of dsRNA targeting both mouse and rhesus monkey XBP-1.

| *Target | sense (5'-3') | SEQ ID NO | antisense (5'-3') | SEQ ID NO |
|---|---|---|---|---|
| 27-45 | CUAUGGUGGUGGUGGCAGCNN | 4040 | GCUGCCACCACCACCAUAGNN | 4140 |
| 732-750 | CUUACCAGCCUCCCUUUCUNN | 4041 | AGAAAGGGAGGCUGGUAAGNN | 4141 |

*Target refers location of target sequence in NM_013842 (*Mus musculis* XPB1 mRNA).
Sense and antisense sequences are described with optional dinucleotide (NN) overhangs.

SEQUENCE LISTING (4166 sequences)

SEQ ID NO: 1 - DNA, 21 bp, Artificial Sequence
  Description of Artificial Sequence: Synthetic oligonucleotide
  Description of Combined DNA/RNA Molecule: Synthetic oligonucleotide
agcgacgucgaggcgcucatt

SEQ ID NO: 2 - DNA, 21 bp, Artificial Sequence
  Description of Artificial Sequence: Synthetic oligonucleotide
  Description of Combined DNA/RNA Molecule: Synthetic oligonucleotide
ugagcgccucgacgucgcutt

SEQ ID NO: 3 - DNA, 21 bp, Artificial Sequence
  Description of Artificial Sequence: Synthetic oligonucleotide
  Description of Combined DNA/RNA Molecule: Synthetic oligonucleotide
cgcucaugguugcaggcggtt

SEQ ID NO: 4 - DNA, 21 bp, Artificial Sequence
  Description of Artificial Sequence: Synthetic oligonucleotide
  Description of Combined DNA/RNA Molecule: Synthetic oligonucleotide
ccgccugcaaccaugagcgtt

SEQ ID NO: 5 - DNA, 21 bp, Artificial Sequence
  Description of Artificial Sequence: Synthetic oligonucleotide
  Description of Combined DNA/RNA Molecule: Synthetic oligonucleotide
gcucaugguugcaggcgggtt

SEQ ID NO: 6 - DNA, 21 bp, Artificial Sequence
  Description of Artificial Sequence: Synthetic oligonucleotide
  Description of Combined DNA/RNA Molecule: Synthetic oligonucleotide
cccgccugcaaccaugagctt

SEQ ID NO: 7 - DNA, 21 bp, Artificial Sequence
  Description of Artificial Sequence: Synthetic oligonucleotide
  Description of Combined DNA/RNA Molecule: Synthetic oligonucleotide
gcgggcgccgccguucagutt

SEQ ID NO: 8 - DNA, 21 bp, Artificial Sequence
  Description of Artificial Sequence: Synthetic oligonucleotide
  Description of Combined DNA/RNA Molecule: Synthetic oligonucleotide
acugaacggcggcgcccgctt

SEQ ID NO: 9 - DNA, 21 bp, Artificial Sequence
  Description of Artificial Sequence: Synthetic oligonucleotide
  Description of Combined DNA/RNA Molecule: Synthetic oligonucleotide
cgggcgccgccguucaguutt

SEQ ID NO: 10 - DNA, 21 bp, Artificial Sequence
  Description of Artificial Sequence: Synthetic oligonucleotide
  Description of Combined DNA/RNA Molecule: Synthetic oligonucleotide
aacugaacggcggcgcccgtt

SEQ ID NO: 11 - DNA, 21 bp, Artificial Sequence
  Description of Artificial Sequence: Synthetic oligonucleotide
  Description of Combined DNA/RNA Molecule: Synthetic oligonucleotide
gggcgccgccguucaguuctt

SEQ ID NO: 12 - DNA, 21 bp, Artificial Sequence
  Description of Artificial Sequence: Synthetic oligonucleotide
  Description of Combined DNA/RNA Molecule: Synthetic oligonucleotide
gaacugaacggcggcgccctt

SEQ ID NO: 13 - DNA, 21 bp, Artificial Sequence
  Description of Artificial Sequence: Synthetic oligonucleotide
  Description of Combined DNA/RNA Molecule: Synthetic oligonucleotide
ccguucaguucagggucugtt

SEQ ID NO: 14 - DNA, 21 bp, Artificial Sequence
  Description of Artificial Sequence: Synthetic oligonucleotide
  Description of Combined DNA/RNA Molecule: Synthetic oligonucleotide
cagacccugaacugaacggtt

SEQ ID NO: 15 - DNA, 21 bp, Artificial Sequence
  Description of Artificial Sequence: Synthetic oligonucleotide
  Description of Combined DNA/RNA Molecule: Synthetic oligonucleotide
uucaguucagggucugagctt

SEQ ID NO: 16 - DNA, 21 bp, Artificial Sequence
  Description of Artificial Sequence: Synthetic oligonucleotide
  Description of Combined DNA/RNA Molecule: Synthetic oligonucleotide
gcucagacccugaacugaatt

SEQ ID NO: 17 - DNA, 21 bp, Artificial Sequence
  Description of Artificial Sequence: Synthetic oligonucleotide
  Description of Combined DNA/RNA Molecule: Synthetic oligonucleotide
gugagacuggcucgggcggtt

SEQ ID NO: 18 - DNA, 21 bp, Artificial Sequence
  Description of Artificial Sequence: Synthetic oligonucleotide
  Description of Combined DNA/RNA Molecule: Synthetic oligonucleotide
ccgcccgagccagucucactt

SEQ ID NO: 19 - DNA, 21 bp, Artificial Sequence
  Description of Artificial Sequence: Synthetic oligonucleotide
  Description of Combined DNA/RNA Molecule: Synthetic oligonucleotide
ggccgggacgcgucguugctt

SEQ ID NO: 20 - DNA, 21 bp, Artificial Sequence
  Description of Artificial Sequence: Synthetic oligonucleotide
  Description of Combined DNA/RNA Molecule: Synthetic oligonucleotide
gcaacgacgcgucccggcctt

SEQ ID NO: 21 - DNA, 21 bp, Artificial Sequence
  Description of Artificial Sequence: Synthetic oligonucleotide
  Description of Combined DNA/RNA Molecule: Synthetic oligonucleotide
gccgggacgcgucguugcatt

SEQ ID NO: 22 - DNA, 21 bp, Artificial Sequence
  Description of Artificial Sequence: Synthetic oligonucleotide
  Description of Combined DNA/RNA Molecule: Synthetic oligonucleotide
ugcaacgacgcgucccggctt

SEQ ID NO: 23 - DNA, 21 bp, Artificial Sequence
  Description of Artificial Sequence: Synthetic oligonucleotide
  Description of Combined DNA/RNA Molecule: Synthetic oligonucleotide
ccgggacgcgucguugcagtt

SEQ ID NO: 24 - DNA, 21 bp, Artificial Sequence
  Description of Artificial Sequence: Synthetic oligonucleotide
  Description of Combined DNA/RNA Molecule: Synthetic oligonucleotide
cugcaacgacgcgucccggtt

SEQ ID NO: 25 - DNA, 21 bp, Artificial Sequence
  Description of Artificial Sequence: Synthetic oligonucleotide
  Description of Combined DNA/RNA Molecule: Synthetic oligonucleotide
ggacgcgucguugcagcagtt

SEQ ID NO: 26 - DNA, 21 bp, Artificial Sequence
  Description of Artificial Sequence: Synthetic oligonucleotide
  Description of Combined DNA/RNA Molecule: Synthetic oligonucleotide
cugcugcaacgacgcgucctt

SEQ ID NO: 27 - DNA, 21 bp, Artificial Sequence
  Description of Artificial Sequence: Synthetic oligonucleotide
  Description of Combined DNA/RNA Molecule: Synthetic oligonucleotide
ucccagccaggauuccgcgtt

SEQ ID NO: 28 - DNA, 21 bp, Artificial Sequence
  Description of Artificial Sequence: Synthetic oligonucleotide
  Description of Combined DNA/RNA Molecule: Synthetic oligonucleotide
cgcggaauccuggcugggatt

SEQ ID NO: 29 - DNA, 21 bp, Artificial Sequence
  Description of Artificial Sequence: Synthetic oligonucleotide
  Description of Combined DNA/RNA Molecule: Synthetic oligonucleotide
ucccagccaggauuccgcgtt

SEQ ID NO: 30 - DNA, 21 bp, Artificial Sequence
  Description of Artificial Sequence: Synthetic oligonucleotide
  Description of Combined DNA/RNA Molecule: Synthetic oligonucleotide
cgcggaauccuggcugggatt

SEQ ID NO: 31 - DNA, 21 bp, Artificial Sequence
  Description of Artificial Sequence: Synthetic oligonucleotide
  Description of Combined DNA/RNA Molecule: Synthetic oligonucleotide
cccagccaggauuccgcgctt

SEQ ID NO: 32 - DNA, 21 bp, Artificial Sequence
  Description of Artificial Sequence: Synthetic oligonucleotide
  Description of Combined DNA/RNA Molecule: Synthetic oligonucleotide
gcgcggaauccuggcugggtt

SEQ ID NO: 33 - DNA, 21 bp, Artificial Sequence
  Description of Artificial Sequence: Synthetic oligonucleotide
  Description of Combined DNA/RNA Molecule: Synthetic oligonucleotide
cccagccaggauuccgcgctt

SEQ ID NO: 34 - DNA, 21 bp, Artificial Sequence
  Description of Artificial Sequence: Synthetic oligonucleotide
  Description of Combined DNA/RNA Molecule: Synthetic oligonucleotide
gcgcggaauccuggcugggtt

SEQ ID NO: 35 - DNA, 21 bp, Artificial Sequence
  Description of Artificial Sequence: Synthetic oligonucleotide
  Description of Combined DNA/RNA Molecule: Synthetic oligonucleotide
cagccaggauuccgcgcgctt

SEQ ID NO: 36 - DNA, 21 bp, Artificial Sequence
  Description of Artificial Sequence: Synthetic oligonucleotide
  Description of Combined DNA/RNA Molecule: Synthetic oligonucleotide
gcgcgcggaauccuggcugtt

SEQ ID NO: 37 - DNA, 21 bp, Artificial Sequence
  Description of Artificial Sequence: Synthetic oligonucleotide
  Description of Combined DNA/RNA Molecule: Synthetic oligonucleotide
cagccaggauuccgcgcgctt

SEQ ID NO: 38 - DNA, 21 bp, Artificial Sequence
  Description of Artificial Sequence: Synthetic oligonucleotide
  Description of Combined DNA/RNA Molecule: Synthetic oligonucleotide
gcgcgcggaauccuggcugtt

SEQ ID NO: 39 - DNA, 21 bp, Artificial Sequence
  Description of Artificial Sequence: Synthetic oligonucleotide
  Description of Combined DNA/RNA Molecule: Synthetic oligonucleotide
agcuccugcacaguccucctt

SEQ ID NO: 40 - DNA, 21 bp, Artificial Sequence
  Description of Artificial Sequence: Synthetic oligonucleotide
  Description of Combined DNA/RNA Molecule: Synthetic oligonucleotide
ggaggacugugcaggagcutt

SEQ ID NO: 41 - DNA, 21 bp, Artificial Sequence
  Description of Artificial Sequence: Synthetic oligonucleotide
  Description of Combined DNA/RNA Molecule: Synthetic oligonucleotide
agcuccugcacaguccucctt

SEQ ID NO: 42 - DNA, 21 bp, Artificial Sequence
  Description of Artificial Sequence: Synthetic oligonucleotide
  Description of Combined DNA/RNA Molecule: Synthetic oligonucleotide
ggaggacugugcaggagcutt

SEQ ID NO: 43 - DNA, 21 bp, Artificial Sequence
  Description of Artificial Sequence: Synthetic oligonucleotide
  Description of Combined DNA/RNA Molecule: Synthetic oligonucleotide
caccgcaaggcucaaggcgtt

SEQ ID NO: 44 - DNA, 21 bp, Artificial Sequence
  Description of Artificial Sequence: Synthetic oligonucleotide
  Description of Combined DNA/RNA Molecule: Synthetic oligonucleotide
cgccuugagccuugcggugtt

SEQ ID NO: 45 - DNA, 21 bp, Artificial Sequence
  Description of Artificial Sequence: Synthetic oligonucleotide
  Description of Combined DNA/RNA Molecule: Synthetic oligonucleotide
cgcaaggcucaaggcgccgtt

SEQ ID NO: 46 - DNA, 21 bp, Artificial Sequence
  Description of Artificial Sequence: Synthetic oligonucleotide
  Description of Combined DNA/RNA Molecule: Synthetic oligonucleotide
cggcgccuugagccuugcgtt

SEQ ID NO: 47 - DNA, 21 bp, Artificial Sequence
  Description of Artificial Sequence: Synthetic oligonucleotide
  Description of Combined DNA/RNA Molecule: Synthetic oligonucleotide
caaggcucaaggcgccgcctt

SEQ ID NO: 48 - DNA, 21 bp, Artificial Sequence
  Description of Artificial Sequence: Synthetic oligonucleotide
  Description of Combined DNA/RNA Molecule: Synthetic oligonucleotide
ggcggcgccuugagccuugtt

SEQ ID NO: 49 - DNA, 21 bp, Artificial Sequence
  Description of Artificial Sequence: Synthetic oligonucleotide
  Description of Combined DNA/RNA Molecule: Synthetic oligonucleotide
guggaccgcgcacggccuctt

SEQ ID NO: 50 - DNA, 21 bp, Artificial Sequence
  Description of Artificial Sequence: Synthetic oligonucleotide
  Description of Combined DNA/RNA Molecule: Synthetic oligonucleotide
gaggccgugcgcgguccactt

SEQ ID NO: 51 - DNA, 21 bp, Artificial Sequence
  Description of Artificial Sequence: Synthetic oligonucleotide
  Description of Combined DNA/RNA Molecule: Synthetic oligonucleotide
uggaccgcgcacggccucutt

SEQ ID NO: 52 - DNA, 21 bp, Artificial Sequence
  Description of Artificial Sequence: Synthetic oligonucleotide
  Description of Combined DNA/RNA Molecule: Synthetic oligonucleotide
agaggccgugcgcgguccatt

SEQ ID NO: 53 - DNA, 21 bp, Artificial Sequence
  Description of Artificial Sequence: Synthetic oligonucleotide
  Description of Combined DNA/RNA Molecule: Synthetic oligonucleotide
ggaccgcgcacggccucuatt

SEQ ID NO: 54 - DNA, 21 bp, Artificial Sequence
  Description of Artificial Sequence: Synthetic oligonucleotide
  Description of Combined DNA/RNA Molecule: Synthetic oligonucleotide
uagaggccgugcgcggucctt

SEQ ID NO: 55 - DNA, 21 bp, Artificial Sequence
  Description of Artificial Sequence: Synthetic oligonucleotide
  Description of Combined DNA/RNA Molecule: Synthetic oligonucleotide
gaccgcgcacggccucuagtt

SEQ ID NO: 56 - DNA, 21 bp, Artificial Sequence
  Description of Artificial Sequence: Synthetic oligonucleotide
  Description of Combined DNA/RNA Molecule: Synthetic oligonucleotide
cuagaggccgugcgcgguctt

SEQ ID NO: 57 - DNA, 21 bp, Artificial Sequence
  Description of Artificial Sequence: Synthetic oligonucleotide
  Description of Combined DNA/RNA Molecule: Synthetic oligonucleotide
accgcgcacggccucuaggtt

SEQ ID NO: 58 - DNA, 21 bp, Artificial Sequence
  Description of Artificial Sequence: Synthetic oligonucleotide
  Description of Combined DNA/RNA Molecule: Synthetic oligonucleotide
ccuagaggccgugcgcggutt

SEQ ID NO: 59 - DNA, 21 bp, Artificial Sequence
  Description of Artificial Sequence: Synthetic oligonucleotide
  Description of Combined DNA/RNA Molecule: Synthetic oligonucleotide
ccgcgcacggccucuaggutt

SEQ ID NO: 60 - DNA, 21 bp, Artificial Sequence
  Description of Artificial Sequence: Synthetic oligonucleotide
  Description of Combined DNA/RNA Molecule: Synthetic oligonucleotide
accuagaggccgugcgcggtt

SEQ ID NO: 61 - DNA, 21 bp, Artificial Sequence
  Description of Artificial Sequence: Synthetic oligonucleotide
  Description of Combined DNA/RNA Molecule: Synthetic oligonucleotide
cgcgcacggccucuagguctt

SEQ ID NO: 62 - DNA, 21 bp, Artificial Sequence
  Description of Artificial Sequence: Synthetic oligonucleotide
  Description of Combined DNA/RNA Molecule: Synthetic oligonucleotide
gaccuagaggccgugcgcgtt

SEQ ID NO: 63 - DNA, 21 bp, Artificial Sequence
  Description of Artificial Sequence: Synthetic oligonucleotide
  Description of Combined DNA/RNA Molecule: Synthetic oligonucleotide
gcgcacggccucuaggucutt

SEQ ID NO: 64 - DNA, 21 bp, Artificial Sequence
  Description of Artificial Sequence: Synthetic oligonucleotide
  Description of Combined DNA/RNA Molecule: Synthetic oligonucleotide
agaccuagaggccgugcgctt

SEQ ID NO: 65 - DNA, 21 bp, Artificial Sequence
  Description of Artificial Sequence: Synthetic oligonucleotide
  Description of Combined DNA/RNA Molecule: Synthetic oligonucleotide
cgcacggccucuaggucuctt

SEQ ID NO: 66 - DNA, 21 bp, Artificial Sequence
  Description of Artificial Sequence: Synthetic oligonucleotide
  Description of Combined DNA/RNA Molecule: Synthetic oligonucleotide
gagaccuagaggccgugcgtt

SEQ ID NO: 67 - DNA, 21 bp, Artificial Sequence
  Description of Artificial Sequence: Synthetic oligonucleotide
  Description of Combined DNA/RNA Molecule: Synthetic oligonucleotide
cucuaggucuccucgccagtt

SEQ ID NO: 68 - DNA, 21 bp, Artificial Sequence
  Description of Artificial Sequence: Synthetic oligonucleotide
  Description of Combined DNA/RNA Molecule: Synthetic oligonucleotide
cuggcgaggagaccuagagtt

SEQ ID NO: 69 - DNA, 21 bp, Artificial Sequence
  Description of Artificial Sequence: Synthetic oligonucleotide
  Description of Combined DNA/RNA Molecule: Synthetic oligonucleotide
ucuaggucuccucgccaggtt

SEQ ID NO: 70 - DNA, 21 bp, Artificial Sequence
  Description of Artificial Sequence: Synthetic oligonucleotide
  Description of Combined DNA/RNA Molecule: Synthetic oligonucleotide
ccuggcgaggagaccuagatt

SEQ ID NO: 71 - DNA, 21 bp, Artificial Sequence
  Description of Artificial Sequence: Synthetic oligonucleotide
  Description of Combined DNA/RNA Molecule: Synthetic oligonucleotide
cuaggucuccucgccaggatt

SEQ ID NO: 72 - DNA, 21 bp, Artificial Sequence
  Description of Artificial Sequence: Synthetic oligonucleotide
  Description of Combined DNA/RNA Molecule: Synthetic oligonucleotide
uccuggcgaggagaccuagtt

SEQ ID NO: 73 - DNA, 21 bp, Artificial Sequence
  Description of Artificial Sequence: Synthetic oligonucleotide
  Description of Combined DNA/RNA Molecule: Synthetic oligonucleotide
aggucuccucgccaggacatt

SEQ ID NO: 74 - DNA, 21 bp, Artificial Sequence
  Description of Artificial Sequence: Synthetic oligonucleotide
  Description of Combined DNA/RNA Molecule: Synthetic oligonucleotide
uguccuggcgaggagaccutt

SEQ ID NO: 75 - DNA, 21 bp, Artificial Sequence
  Description of Artificial Sequence: Synthetic oligonucleotide
  Description of Combined DNA/RNA Molecule: Synthetic oligonucleotide
ccucgccaggacagcaacctt

SEQ ID NO: 76 - DNA, 21 bp, Artificial Sequence
  Description of Artificial Sequence: Synthetic oligonucleotide
  Description of Combined DNA/RNA Molecule: Synthetic oligonucleotide
gguugcuguccuggcgaggtt

SEQ ID NO: 77 - DNA, 21 bp, Artificial Sequence
  Description of Artificial Sequence: Synthetic oligonucleotide
  Description of Combined DNA/RNA Molecule: Synthetic oligonucleotide
cgucagcuccaggcggucctt

SEQ ID NO: 78 - DNA, 21 bp, Artificial Sequence
  Description of Artificial Sequence: Synthetic oligonucleotide
  Description of Combined DNA/RNA Molecule: Synthetic oligonucleotide
ggaccgccuggagcugacgtt

SEQ ID NO: 79 - DNA, 21 bp, Artificial Sequence
  Description of Artificial Sequence: Synthetic oligonucleotide
  Description of Combined DNA/RNA Molecule: Synthetic oligonucleotide
cgucagcuccaggcggucctt

SEQ ID NO: 80 - DNA, 21 bp, Artificial Sequence
  Description of Artificial Sequence: Synthetic oligonucleotide
  Description of Combined DNA/RNA Molecule: Synthetic oligonucleotide
ggaccgccuggagcugacgtt

SEQ ID NO: 81 - DNA, 21 bp, Artificial Sequence
  Description of Artificial Sequence: Synthetic oligonucleotide
  Description of Combined DNA/RNA Molecule: Synthetic oligonucleotide
gucagcuccaggcgguccutt

SEQ ID NO: 82 - DNA, 21 bp, Artificial Sequence
  Description of Artificial Sequence: Synthetic oligonucleotide
  Description of Combined DNA/RNA Molecule: Synthetic oligonucleotide
aggaccgccuggagcugactt

SEQ ID NO: 83 - DNA, 21 bp, Artificial Sequence
  Description of Artificial Sequence: Synthetic oligonucleotide
  Description of Combined DNA/RNA Molecule: Synthetic oligonucleotide
gucagcuccaggcgguccutt

SEQ ID NO: 84 - DNA, 21 bp, Artificial Sequence
  Description of Artificial Sequence: Synthetic oligonucleotide
  Description of Combined DNA/RNA Molecule: Synthetic oligonucleotide
aggaccgccuggagcugactt

SEQ ID NO: 85 - DNA, 21 bp, Artificial Sequence
  Description of Artificial Sequence: Synthetic oligonucleotide
  Description of Combined DNA/RNA Molecule: Synthetic oligonucleotide
ggcgcccgugcgcaggaggtt

SEQ ID NO: 86 - DNA, 21 bp, Artificial Sequence
  Description of Artificial Sequence: Synthetic oligonucleotide
  Description of Combined DNA/RNA Molecule: Synthetic oligonucleotide
ccuccugcgcacgggcgcctt

SEQ ID NO: 87 - DNA, 21 bp, Artificial Sequence
  Description of Artificial Sequence: Synthetic oligonucleotide
  Description of Combined DNA/RNA Molecule: Synthetic oligonucleotide
ggagcuggugcuagccuugtt

SEQ ID NO: 88 - DNA, 21 bp, Artificial Sequence
  Description of Artificial Sequence: Synthetic oligonucleotide
  Description of Combined DNA/RNA Molecule: Synthetic oligonucleotide
caaggcuagcaccagcucctt

SEQ ID NO: 89 - DNA, 21 bp, Artificial Sequence
  Description of Artificial Sequence: Synthetic oligonucleotide
  Description of Combined DNA/RNA Molecule: Synthetic oligonucleotide
ggagcuggugcuagccuugtt

SEQ ID NO: 90 - DNA, 21 bp, Artificial Sequence
  Description of Artificial Sequence: Synthetic oligonucleotide
  Description of Combined DNA/RNA Molecule: Synthetic oligonucleotide
caaggcuagcaccagcucctt

SEQ ID NO: 91 - DNA, 21 bp, Artificial Sequence
  Description of Artificial Sequence: Synthetic oligonucleotide
  Description of Combined DNA/RNA Molecule: Synthetic oligonucleotide
gcuggugcuagccuugcgutt

SEQ ID NO: 92 - DNA, 21 bp, Artificial Sequence
  Description of Artificial Sequence: Synthetic oligonucleotide
  Description of Combined DNA/RNA Molecule: Synthetic oligonucleotide
acgcaaggcuagcaccagctt

SEQ ID NO: 93 - DNA, 21 bp, Artificial Sequence
  Description of Artificial Sequence: Synthetic oligonucleotide
  Description of Combined DNA/RNA Molecule: Synthetic oligonucleotide
gcuggugcuagccuugcgutt

SEQ ID NO: 94 - DNA, 21 bp, Artificial Sequence
  Description of Artificial Sequence: Synthetic oligonucleotide
  Description of Combined DNA/RNA Molecule: Synthetic oligonucleotide
acgcaaggcuagcaccagctt

SEQ ID NO: 95 - DNA, 21 bp, Artificial Sequence
  Description of Artificial Sequence: Synthetic oligonucleotide
  Description of Combined DNA/RNA Molecule: Synthetic oligonucleotide
cuggugcuagccuugcguutt

SEQ ID NO: 96 - DNA, 21 bp, Artificial Sequence
  Description of Artificial Sequence: Synthetic oligonucleotide
  Description of Combined DNA/RNA Molecule: Synthetic oligonucleotide
aacgcaaggcuagcaccagtt

SEQ ID NO: 97 - DNA, 21 bp, Artificial Sequence
  Description of Artificial Sequence: Synthetic oligonucleotide
  Description of Combined DNA/RNA Molecule: Synthetic oligonucleotide
cuggugcuagccuugcguutt

SEQ ID NO: 98 - DNA, 21 bp, Artificial Sequence
  Description of Artificial Sequence: Synthetic oligonucleotide
  Description of Combined DNA/RNA Molecule: Synthetic oligonucleotide
aacgcaaggcuagcaccagtt

SEQ ID NO: 99 - DNA, 21 bp, Artificial Sequence
  Description of Artificial Sequence: Synthetic oligonucleotide
  Description of Combined DNA/RNA Molecule: Synthetic oligonucleotide
cuggugcuagccuugcguutt

SEQ ID NO: 100 - DNA, 21 bp, Artificial Sequence
  Description of Artificial Sequence: Synthetic oligonucleotide
  Description of Combined DNA/RNA Molecule: Synthetic oligonucleotide
aacgcaaggcuagcaccagtt

SEQ ID NO: 101 - DNA, 21 bp, Artificial Sequence
  Description of Artificial Sequence: Synthetic oligonucleotide
  Description of Combined DNA/RNA Molecule: Synthetic oligonucleotide
ugcuagccuugcguuccgatt

SEQ ID NO: 102 - DNA, 21 bp, Artificial Sequence
  Description of Artificial Sequence: Synthetic oligonucleotide
  Description of Combined DNA/RNA Molecule: Synthetic oligonucleotide
ucggaacgcaaggcuagcatt

SEQ ID NO: 103 - DNA, 21 bp, Artificial Sequence
  Description of Artificial Sequence: Synthetic oligonucleotide
  Description of Combined DNA/RNA Molecule: Synthetic oligonucleotide
ugcuagccuugcguuccgatt

SEQ ID NO: 104 - DNA, 21 bp, Artificial Sequence
  Description of Artificial Sequence: Synthetic oligonucleotide
  Description of Combined DNA/RNA Molecule: Synthetic oligonucleotide
ucggaacgcaaggcuagcatt

SEQ ID NO: 105 - DNA, 21 bp, Artificial Sequence
  Description of Artificial Sequence: Synthetic oligonucleotide
  Description of Combined DNA/RNA Molecule: Synthetic oligonucleotide
uagccuugcguuccgaggatt

SEQ ID NO: 106 - DNA, 21 bp, Artificial Sequence
  Description of Artificial Sequence: Synthetic oligonucleotide
  Description of Combined DNA/RNA Molecule: Synthetic oligonucleotide
uccucggaacgcaaggcuatt

SEQ ID NO: 107 - DNA, 21 bp, Artificial Sequence
  Description of Artificial Sequence: Synthetic oligonucleotide
  Description of Combined DNA/RNA Molecule: Synthetic oligonucleotide
uagccuugcguuccgaggatt

SEQ ID NO: 108 - DNA, 21 bp, Artificial Sequence
  Description of Artificial Sequence: Synthetic oligonucleotide
  Description of Combined DNA/RNA Molecule: Synthetic oligonucleotide
uccucggaacgcaaggcuatt

SEQ ID NO: 109 - DNA, 21 bp, Artificial Sequence
  Description of Artificial Sequence: Synthetic oligonucleotide
  Description of Combined DNA/RNA Molecule: Synthetic oligonucleotide
gacggccuggccgaagcactt

SEQ ID NO: 110 - DNA, 21 bp, Artificial Sequence
  Description of Artificial Sequence: Synthetic oligonucleotide
  Description of Combined DNA/RNA Molecule: Synthetic oligonucleotide
gugcuucggccaggccguctt

SEQ ID NO: 111 - DNA, 21 bp, Artificial Sequence
  Description of Artificial Sequence: Synthetic oligonucleotide
  Description of Combined DNA/RNA Molecule: Synthetic oligonucleotide
ggccgaagcacccgagcactt

SEQ ID NO: 112 - DNA, 21 bp, Artificial Sequence
  Description of Artificial Sequence: Synthetic oligonucleotide
  Description of Combined DNA/RNA Molecule: Synthetic oligonucleotide
gugcucgggugcuucggcctt

SEQ ID NO: 113 - DNA, 21 bp, Artificial Sequence
  Description of Artificial Sequence: Synthetic oligonucleotide
  Description of Combined DNA/RNA Molecule: Synthetic oligonucleotide
gccgaagcacccgagcacgtt

SEQ ID NO: 114 - DNA, 21 bp, Artificial Sequence
  Description of Artificial Sequence: Synthetic oligonucleotide
  Description of Combined DNA/RNA Molecule: Synthetic oligonucleotide
cgugcucgggugcuucggctt

SEQ ID NO: 115 - DNA, 21 bp, Artificial Sequence
  Description of Artificial Sequence: Synthetic oligonucleotide
  Description of Combined DNA/RNA Molecule: Synthetic oligonucleotide
ccgaagcacccgagcacggtt

SEQ ID NO: 116 - DNA, 21 bp, Artificial Sequence
  Description of Artificial Sequence: Synthetic oligonucleotide
  Description of Combined DNA/RNA Molecule: Synthetic oligonucleotide
ccgugcucgggugcuucggtt

SEQ ID NO: 117 - DNA, 21 bp, Artificial Sequence
  Description of Artificial Sequence: Synthetic oligonucleotide
  Description of Combined DNA/RNA Molecule: Synthetic oligonucleotide
ccgagcacggaaccacagctt

SEQ ID NO: 118 - DNA, 21 bp, Artificial Sequence
  Description of Artificial Sequence: Synthetic oligonucleotide
  Description of Combined DNA/RNA Molecule: Synthetic oligonucleotide
gcugugguuccgugcucggtt

SEQ ID NO: 119 - DNA, 21 bp, Artificial Sequence
  Description of Artificial Sequence: Synthetic oligonucleotide
  Description of Combined DNA/RNA Molecule: Synthetic oligonucleotide
caccgcugcgccaaggauctt

SEQ ID NO: 120 - DNA, 21 bp, Artificial Sequence
  Description of Artificial Sequence: Synthetic oligonucleotide
  Description of Combined DNA/RNA Molecule: Synthetic oligonucleotide
gauccuuggcgcagcggugtt

SEQ ID NO: 121 - DNA, 21 bp, Artificial Sequence
  Description of Artificial Sequence: Synthetic oligonucleotide
  Description of Combined DNA/RNA Molecule: Synthetic oligonucleotide
ccgcugcgccaaggauccgtt

SEQ ID NO: 122 - DNA, 21 bp, Artificial Sequence
  Description of Artificial Sequence: Synthetic oligonucleotide
  Description of Combined DNA/RNA Molecule: Synthetic oligonucleotide
cggauccuuggcgcagcggtt

SEQ ID NO: 123 - DNA, 21 bp, Artificial Sequence
  Description of Artificial Sequence: Synthetic oligonucleotide
  Description of Combined DNA/RNA Molecule: Synthetic oligonucleotide
cgcugcgccaaggauccgutt

SEQ ID NO: 124 - DNA, 21 bp, Artificial Sequence
  Description of Artificial Sequence: Synthetic oligonucleotide
  Description of Combined DNA/RNA Molecule: Synthetic oligonucleotide
acggauccuuggcgcagcgtt

SEQ ID NO: 125 - DNA, 21 bp, Artificial Sequence
  Description of Artificial Sequence: Synthetic oligonucleotide
  Description of Combined DNA/RNA Molecule: Synthetic oligonucleotide
cugcgccaaggauccguggtt

SEQ ID NO: 126 - DNA, 21 bp, Artificial Sequence
  Description of Artificial Sequence: Synthetic oligonucleotide
  Description of Combined DNA/RNA Molecule: Synthetic oligonucleotide
ccacggauccuuggcgcagtt

SEQ ID NO: 127 - DNA, 21 bp, Artificial Sequence
  Description of Artificial Sequence: Synthetic oligonucleotide
  Description of Combined DNA/RNA Molecule: Synthetic oligonucleotide
auccguggagguugccuggtt

SEQ ID NO: 128 - DNA, 21 bp, Artificial Sequence
  Description of Artificial Sequence: Synthetic oligonucleotide
  Description of Combined DNA/RNA Molecule: Synthetic oligonucleotide
ccaggcaaccuccacggautt

SEQ ID NO: 129 - DNA, 21 bp, Artificial Sequence
  Description of Artificial Sequence: Synthetic oligonucleotide
  Description of Combined DNA/RNA Molecule: Synthetic oligonucleotide
gguugccuggcaccuacgutt

SEQ ID NO: 130 - DNA, 21 bp, Artificial Sequence
  Description of Artificial Sequence: Synthetic oligonucleotide
  Description of Combined DNA/RNA Molecule: Synthetic oligonucleotide
acguaggugccaggcaacctt

SEQ ID NO: 131 - DNA, 21 bp, Artificial Sequence
  Description of Artificial Sequence: Synthetic oligonucleotide
  Description of Combined DNA/RNA Molecule: Synthetic oligonucleotide
aggagacccaccucucgcatt

SEQ ID NO: 132 - DNA, 21 bp, Artificial Sequence
  Description of Artificial Sequence: Synthetic oligonucleotide
  Description of Combined DNA/RNA Molecule: Synthetic oligonucleotide
ugcgagaggugggucuccutt

SEQ ID NO: 133 - DNA, 21 bp, Artificial Sequence
  Description of Artificial Sequence: Synthetic oligonucleotide
  Description of Combined DNA/RNA Molecule: Synthetic oligonucleotide
ggagacccaccucucgcagtt

SEQ ID NO: 134 - DNA, 21 bp, Artificial Sequence
  Description of Artificial Sequence: Synthetic oligonucleotide
  Description of Combined DNA/RNA Molecule: Synthetic oligonucleotide
cugcgagaggugggucucctt

SEQ ID NO: 135 - DNA, 21 bp, Artificial Sequence
  Description of Artificial Sequence: Synthetic oligonucleotide
  Description of Combined DNA/RNA Molecule: Synthetic oligonucleotide
gagacccaccucucgcagutt

SEQ ID NO: 136 - DNA, 21 bp, Artificial Sequence
  Description of Artificial Sequence: Synthetic oligonucleotide
  Description of Combined DNA/RNA Molecule: Synthetic oligonucleotide
acugcgagaggugggucuctt

SEQ ID NO: 137 - DNA, 21 bp, Artificial Sequence
  Description of Artificial Sequence: Synthetic oligonucleotide
  Description of Combined DNA/RNA Molecule: Synthetic oligonucleotide
ccaccucucgcagucagagtt

SEQ ID NO: 138 - DNA, 21 bp, Artificial Sequence
  Description of Artificial Sequence: Synthetic oligonucleotide
  Description of Combined DNA/RNA Molecule: Synthetic oligonucleotide
cucugacugcgagagguggtt

SEQ ID NO: 139 - DNA, 21 bp, Artificial Sequence
  Description of Artificial Sequence: Synthetic oligonucleotide
  Description of Combined DNA/RNA Molecule: Synthetic oligonucleotide
ccucucgcagucagagcgctt

SEQ ID NO: 140 - DNA, 21 bp, Artificial Sequence
  Description of Artificial Sequence: Synthetic oligonucleotide
  Description of Combined DNA/RNA Molecule: Synthetic oligonucleotide
gcgcucugacugcgagaggtt

SEQ ID NO: 141 - DNA, 21 bp, Artificial Sequence
  Description of Artificial Sequence: Synthetic oligonucleotide
  Description of Combined DNA/RNA Molecule: Synthetic oligonucleotide
cucucgcagucagagcgcatt

SEQ ID NO: 142 - DNA, 21 bp, Artificial Sequence
  Description of Artificial Sequence: Synthetic oligonucleotide
  Description of Combined DNA/RNA Molecule: Synthetic oligonucleotide
ugcgcucugacugcgagagtt

SEQ ID NO: 143 - DNA, 21 bp, Artificial Sequence
  Description of Artificial Sequence: Synthetic oligonucleotide
  Description of Combined DNA/RNA Molecule: Synthetic oligonucleotide
ucucgcagucagagcgcactt

SEQ ID NO: 144 - DNA, 21 bp, Artificial Sequence
  Description of Artificial Sequence: Synthetic oligonucleotide
  Description of Combined DNA/RNA Molecule: Synthetic oligonucleotide
gugcgcucugacugcgagatt

SEQ ID NO: 145 - DNA, 21 bp, Artificial Sequence
  Description of Artificial Sequence: Synthetic oligonucleotide
  Description of Combined DNA/RNA Molecule: Synthetic oligonucleotide
cucgcagucagagcgcacutt

SEQ ID NO: 146 - DNA, 21 bp, Artificial Sequence
  Description of Artificial Sequence: Synthetic oligonucleotide
  Description of Combined DNA/RNA Molecule: Synthetic oligonucleotide
agugcgcucugacugcgagtt

SEQ ID NO: 147 - DNA, 21 bp, Artificial Sequence
  Description of Artificial Sequence: Synthetic oligonucleotide
  Description of Combined DNA/RNA Molecule: Synthetic oligonucleotide
cucgcagucagagcgcacutt

SEQ ID NO: 148 - DNA, 21 bp, Artificial Sequence
  Description of Artificial Sequence: Synthetic oligonucleotide
  Description of Combined DNA/RNA Molecule: Synthetic oligonucleotide
agugcgcucugacugcgagtt

SEQ ID NO: 149 - DNA, 21 bp, Artificial Sequence
  Description of Artificial Sequence: Synthetic oligonucleotide
  Description of Combined DNA/RNA Molecule: Synthetic oligonucleotide
gcagucagagcgcacugcctt

SEQ ID NO: 150 - DNA, 21 bp, Artificial Sequence
  Description of Artificial Sequence: Synthetic oligonucleotide
  Description of Combined DNA/RNA Molecule: Synthetic oligonucleotide
ggcagugcgcucugacugctt

SEQ ID NO: 151 - DNA, 21 bp, Artificial Sequence
  Description of Artificial Sequence: Synthetic oligonucleotide
  Description of Combined DNA/RNA Molecule: Synthetic oligonucleotide
gcagucagagcgcacugcctt

SEQ ID NO: 152 - DNA, 21 bp, Artificial Sequence
  Description of Artificial Sequence: Synthetic oligonucleotide
  Description of Combined DNA/RNA Molecule: Synthetic oligonucleotide
ggcagugcgcucugacugctt

SEQ ID NO: 153 - DNA, 21 bp, Artificial Sequence
  Description of Artificial Sequence: Synthetic oligonucleotide
  Description of Combined DNA/RNA Molecule: Synthetic oligonucleotide
gggauaccucaccaagauctt

SEQ ID NO: 154 - DNA, 21 bp, Artificial Sequence
  Description of Artificial Sequence: Synthetic oligonucleotide
  Description of Combined DNA/RNA Molecule: Synthetic oligonucleotide
gaucuuggugagguauccctt

SEQ ID NO: 155 - DNA, 21 bp, Artificial Sequence
  Description of Artificial Sequence: Synthetic oligonucleotide
  Description of Combined DNA/RNA Molecule: Synthetic oligonucleotide
gggauaccucaccaagauctt

SEQ ID NO: 156 - DNA, 21 bp, Artificial Sequence
  Description of Artificial Sequence: Synthetic oligonucleotide
  Description of Combined DNA/RNA Molecule: Synthetic oligonucleotide
gaucuuggugagguauccctt

SEQ ID NO: 157 - DNA, 21 bp, Artificial Sequence
  Description of Artificial Sequence: Synthetic oligonucleotide
  Description of Combined DNA/RNA Molecule: Synthetic oligonucleotide
uggugaagaugaguggcgatt

SEQ ID NO: 158 - DNA, 21 bp, Artificial Sequence
  Description of Artificial Sequence: Synthetic oligonucleotide
  Description of Combined DNA/RNA Molecule: Synthetic oligonucleotide
ucgccacucaucuucaccatt

SEQ ID NO: 159 - DNA, 21 bp, Artificial Sequence
  Description of Artificial Sequence: Synthetic oligonucleotide
  Description of Combined DNA/RNA Molecule: Synthetic oligonucleotide
uggugaagaugaguggcgatt

SEQ ID NO: 160 - DNA, 21 bp, Artificial Sequence
  Description of Artificial Sequence: Synthetic oligonucleotide
  Description of Combined DNA/RNA Molecule: Synthetic oligonucleotide
ucgccacucaucuucaccatt

SEQ ID NO: 161 - DNA, 21 bp, Artificial Sequence
  Description of Artificial Sequence: Synthetic oligonucleotide
  Description of Combined DNA/RNA Molecule: Synthetic oligonucleotide
gaagaugaguggcgaccugtt

SEQ ID NO: 162 - DNA, 21 bp, Artificial Sequence
  Description of Artificial Sequence: Synthetic oligonucleotide
  Description of Combined DNA/RNA Molecule: Synthetic oligonucleotide
caggucgccacucaucuuctt

SEQ ID NO: 163 - DNA, 21 bp, Artificial Sequence
  Description of Artificial Sequence: Synthetic oligonucleotide
  Description of Combined DNA/RNA Molecule: Synthetic oligonucleotide
gaagaugaguggcgaccugtt

SEQ ID NO: 164 - DNA, 21 bp, Artificial Sequence
  Description of Artificial Sequence: Synthetic oligonucleotide
  Description of Combined DNA/RNA Molecule: Synthetic oligonucleotide
caggucgccacucaucuuctt

SEQ ID NO: 165 - DNA, 21 bp, Artificial Sequence
  Description of Artificial Sequence: Synthetic oligonucleotide
  Description of Combined DNA/RNA Molecule: Synthetic oligonucleotide
cccaugucgacuacaucgatt

SEQ ID NO: 166 - DNA, 21 bp, Artificial Sequence
  Description of Artificial Sequence: Synthetic oligonucleotide
  Description of Combined DNA/RNA Molecule: Synthetic oligonucleotide
ucgauguagucgacaugggtt

SEQ ID NO: 167 - DNA, 21 bp, Artificial Sequence
  Description of Artificial Sequence: Synthetic oligonucleotide
  Description of Combined DNA/RNA Molecule: Synthetic oligonucleotide
cccaugucgacuacaucgatt

SEQ ID NO: 168 - DNA, 21 bp, Artificial Sequence
  Description of Artificial Sequence: Synthetic oligonucleotide
  Description of Combined DNA/RNA Molecule: Synthetic oligonucleotide
ucgauguagucgacaugggtt

SEQ ID NO: 169 - DNA, 21 bp, Artificial Sequence
  Description of Artificial Sequence: Synthetic oligonucleotide
  Description of Combined DNA/RNA Molecule: Synthetic oligonucleotide
aucgaggaggacuccucugtt

SEQ ID NO: 170 - DNA, 21 bp, Artificial Sequence
  Description of Artificial Sequence: Synthetic oligonucleotide
  Description of Combined DNA/RNA Molecule: Synthetic oligonucleotide
cagaggaguccuccucgautt

SEQ ID NO: 171 - DNA, 21 bp, Artificial Sequence
  Description of Artificial Sequence: Synthetic oligonucleotide
  Description of Combined DNA/RNA Molecule: Synthetic oligonucleotide
aucgaggaggacuccucugtt

SEQ ID NO: 172 - DNA, 21 bp, Artificial Sequence
  Description of Artificial Sequence: Synthetic oligonucleotide
  Description of Combined DNA/RNA Molecule: Synthetic oligonucleotide
cagaggaguccuccucgautt

SEQ ID NO: 173 - DNA, 21 bp, Artificial Sequence
  Description of Artificial Sequence: Synthetic oligonucleotide
  Description of Combined DNA/RNA Molecule: Synthetic oligonucleotide
ggaaccuggagcggauuactt

SEQ ID NO: 174 - DNA, 21 bp, Artificial Sequence
  Description of Artificial Sequence: Synthetic oligonucleotide
  Description of Combined DNA/RNA Molecule: Synthetic oligonucleotide
guaauccgcuccagguucctt

SEQ ID NO: 175 - DNA, 21 bp, Artificial Sequence
  Description of Artificial Sequence: Synthetic oligonucleotide
  Description of Combined DNA/RNA Molecule: Synthetic oligonucleotide
gaaccuggagcggauuacctt

SEQ ID NO: 176 - DNA, 21 bp, Artificial Sequence
  Description of Artificial Sequence: Synthetic oligonucleotide
  Description of Combined DNA/RNA Molecule: Synthetic oligonucleotide
gguaauccgcuccagguuctt

SEQ ID NO: 177 - DNA, 21 bp, Artificial Sequence
  Description of Artificial Sequence: Synthetic oligonucleotide
  Description of Combined DNA/RNA Molecule: Synthetic oligonucleotide
aaccuggagcggauuaccctt

SEQ ID NO: 178 - DNA, 21 bp, Artificial Sequence
  Description of Artificial Sequence: Synthetic oligonucleotide
  Description of Combined DNA/RNA Molecule: Synthetic oligonucleotide
ggguaauccgcuccagguutt

SEQ ID NO: 179 - DNA, 21 bp, Artificial Sequence
  Description of Artificial Sequence: Synthetic oligonucleotide
  Description of Combined DNA/RNA Molecule: Synthetic oligonucleotide
cccuccacgguaccgggcgtt

SEQ ID NO: 180 - DNA, 21 bp, Artificial Sequence
  Description of Artificial Sequence: Synthetic oligonucleotide
  Description of Combined DNA/RNA Molecule: Synthetic oligonucleotide
cgcccgguaccguggagggtt

SEQ ID NO: 181 - DNA, 21 bp, Artificial Sequence
  Description of Artificial Sequence: Synthetic oligonucleotide
  Description of Combined DNA/RNA Molecule: Synthetic oligonucleotide
cacgguaccgggcggaugatt

SEQ ID NO: 182 - DNA, 21 bp, Artificial Sequence
  Description of Artificial Sequence: Synthetic oligonucleotide
  Description of Combined DNA/RNA Molecule: Synthetic oligonucleotide
ucauccgcccgguaccgugtt

SEQ ID NO: 183 - DNA, 21 bp, Artificial Sequence
  Description of Artificial Sequence: Synthetic oligonucleotide
  Description of Combined DNA/RNA Molecule: Synthetic oligonucleotide
cacgguaccgggcggaugatt

SEQ ID NO: 184 - DNA, 21 bp, Artificial Sequence
  Description of Artificial Sequence: Synthetic oligonucleotide
  Description of Combined DNA/RNA Molecule: Synthetic oligonucleotide
ucauccgcccgguaccgugtt

SEQ ID NO: 185 - DNA, 21 bp, Artificial Sequence
  Description of Artificial Sequence: Synthetic oligonucleotide
  Description of Combined DNA/RNA Molecule: Synthetic oligonucleotide
acgguaccgggcggaugaatt

SEQ ID NO: 186 - DNA, 21 bp, Artificial Sequence
  Description of Artificial Sequence: Synthetic oligonucleotide
  Description of Combined DNA/RNA Molecule: Synthetic oligonucleotide
uucauccgcccgguaccgutt

SEQ ID NO: 187 - DNA, 21 bp, Artificial Sequence
  Description of Artificial Sequence: Synthetic oligonucleotide
  Description of Combined DNA/RNA Molecule: Synthetic oligonucleotide
acgguaccgggcggaugaatt

SEQ ID NO: 188 - DNA, 21 bp, Artificial Sequence
  Description of Artificial Sequence: Synthetic oligonucleotide
  Description of Combined DNA/RNA Molecule: Synthetic oligonucleotide
uucauccgcccgguaccgutt

SEQ ID NO: 189 - DNA, 21 bp, Artificial Sequence
  Description of Artificial Sequence: Synthetic oligonucleotide
  Description of Combined DNA/RNA Molecule: Synthetic oligonucleotide
cgguaccgggcggaugaautt

SEQ ID NO: 190 - DNA, 21 bp, Artificial Sequence
  Description of Artificial Sequence: Synthetic oligonucleotide
  Description of Combined DNA/RNA Molecule: Synthetic oligonucleotide
auucauccgcccgguaccgtt

SEQ ID NO: 191 - DNA, 21 bp, Artificial Sequence
  Description of Artificial Sequence: Synthetic oligonucleotide
  Description of Combined DNA/RNA Molecule: Synthetic oligonucleotide
cgguaccgggcggaugaautt

SEQ ID NO: 192 - DNA, 21 bp, Artificial Sequence
  Description of Artificial Sequence: Synthetic oligonucleotide
  Description of Combined DNA/RNA Molecule: Synthetic oligonucleotide
auucauccgcccgguaccgtt

SEQ ID NO: 193 - DNA, 21 bp, Artificial Sequence
  Description of Artificial Sequence: Synthetic oligonucleotide
  Description of Combined DNA/RNA Molecule: Synthetic oligonucleotide
gguaccgggcggaugaauatt

SEQ ID NO: 194 - DNA, 21 bp, Artificial Sequence
  Description of Artificial Sequence: Synthetic oligonucleotide
  Description of Combined DNA/RNA Molecule: Synthetic oligonucleotide
uauucauccgcccgguacctt

SEQ ID NO: 195 - DNA, 21 bp, Artificial Sequence
  Description of Artificial Sequence: Synthetic oligonucleotide
  Description of Combined DNA/RNA Molecule: Synthetic oligonucleotide
gguaccgggcggaugaauatt

SEQ ID NO: 196 - DNA, 21 bp, Artificial Sequence
  Description of Artificial Sequence: Synthetic oligonucleotide
  Description of Combined DNA/RNA Molecule: Synthetic oligonucleotide
uauucauccgcccgguacctt

SEQ ID NO: 197 - DNA, 21 bp, Artificial Sequence
  Description of Artificial Sequence: Synthetic oligonucleotide
  Description of Combined DNA/RNA Molecule: Synthetic oligonucleotide
guaccgggcggaugaauactt

SEQ ID NO: 198 - DNA, 21 bp, Artificial Sequence
  Description of Artificial Sequence: Synthetic oligonucleotide
  Description of Combined DNA/RNA Molecule: Synthetic oligonucleotide
guauucauccgcccgguactt

SEQ ID NO: 199 - DNA, 21 bp, Artificial Sequence
  Description of Artificial Sequence: Synthetic oligonucleotide
  Description of Combined DNA/RNA Molecule: Synthetic oligonucleotide
guaccgggcggaugaauactt

SEQ ID NO: 200 - DNA, 21 bp, Artificial Sequence
  Description of Artificial Sequence: Synthetic oligonucleotide
  Description of Combined DNA/RNA Molecule: Synthetic oligonucleotide
guauucauccgcccgguactt

SEQ ID NO: 201 - DNA, 21 bp, Artificial Sequence
  Description of Artificial Sequence: Synthetic oligonucleotide
  Description of Combined DNA/RNA Molecule: Synthetic oligonucleotide
accgggcggaugaauaccatt

SEQ ID NO: 202 - DNA, 21 bp, Artificial Sequence
  Description of Artificial Sequence: Synthetic oligonucleotide
  Description of Combined DNA/RNA Molecule: Synthetic oligonucleotide
ugguauucauccgcccggutt

SEQ ID NO: 203 - DNA, 21 bp, Artificial Sequence
  Description of Artificial Sequence: Synthetic oligonucleotide
  Description of Combined DNA/RNA Molecule: Synthetic oligonucleotide
accgggcggaugaauaccatt

SEQ ID NO: 204 - DNA, 21 bp, Artificial Sequence
  Description of Artificial Sequence: Synthetic oligonucleotide
  Description of Combined DNA/RNA Molecule: Synthetic oligonucleotide
ugguauucauccgcccggutt

SEQ ID NO: 205 - DNA, 21 bp, Artificial Sequence
  Description of Artificial Sequence: Synthetic oligonucleotide
  Description of Combined DNA/RNA Molecule: Synthetic oligonucleotide
ccgggcggaugaauaccagtt

SEQ ID NO: 206 - DNA, 21 bp, Artificial Sequence
  Description of Artificial Sequence: Synthetic oligonucleotide
  Description of Combined DNA/RNA Molecule: Synthetic oligonucleotide
cugguauucauccgcccggtt

SEQ ID NO: 207 - DNA, 21 bp, Artificial Sequence
  Description of Artificial Sequence: Synthetic oligonucleotide
  Description of Combined DNA/RNA Molecule: Synthetic oligonucleotide
ccgggcggaugaauaccagtt

SEQ ID NO: 208 - DNA, 21 bp, Artificial Sequence
  Description of Artificial Sequence: Synthetic oligonucleotide
  Description of Combined DNA/RNA Molecule: Synthetic oligonucleotide
cugguauucauccgcccggtt

SEQ ID NO: 209 - DNA, 21 bp, Artificial Sequence
  Description of Artificial Sequence: Synthetic oligonucleotide
  Description of Combined DNA/RNA Molecule: Synthetic oligonucleotide
ccugguggagguguaucuctt

SEQ ID NO: 210 - DNA, 21 bp, Artificial Sequence
  Description of Artificial Sequence: Synthetic oligonucleotide
  Description of Combined DNA/RNA Molecule: Synthetic oligonucleotide
gagauacaccuccaccaggtt

SEQ ID NO: 211 - DNA, 21 bp, Artificial Sequence
  Description of Artificial Sequence: Synthetic oligonucleotide
  Description of Combined DNA/RNA Molecule: Synthetic oligonucleotide
ccugguggagguguaucuctt

SEQ ID NO: 212 - DNA, 21 bp, Artificial Sequence
  Description of Artificial Sequence: Synthetic oligonucleotide
  Description of Combined DNA/RNA Molecule: Synthetic oligonucleotide
gagauacaccuccaccaggtt

SEQ ID NO: 213 - DNA, 21 bp, Artificial Sequence
  Description of Artificial Sequence: Synthetic oligonucleotide
  Description of Combined DNA/RNA Molecule: Synthetic oligonucleotide
cugguggagguguaucucctt

SEQ ID NO: 214 - DNA, 21 bp, Artificial Sequence
  Description of Artificial Sequence: Synthetic oligonucleotide
  Description of Combined DNA/RNA Molecule: Synthetic oligonucleotide
ggagauacaccuccaccagtt

SEQ ID NO: 215 - DNA, 21 bp, Artificial Sequence
  Description of Artificial Sequence: Synthetic oligonucleotide
  Description of Combined DNA/RNA Molecule: Synthetic oligonucleotide
cugguggagguguaucucctt

SEQ ID NO: 216 - DNA, 21 bp, Artificial Sequence
  Description of Artificial Sequence: Synthetic oligonucleotide
  Description of Combined DNA/RNA Molecule: Synthetic oligonucleotide
ggagauacaccuccaccagtt

SEQ ID NO: 217 - DNA, 21 bp, Artificial Sequence
  Description of Artificial Sequence: Synthetic oligonucleotide
  Description of Combined DNA/RNA Molecule: Synthetic oligonucleotide
ugguggagguguaucuccutt

SEQ ID NO: 218 - DNA, 21 bp, Artificial Sequence
  Description of Artificial Sequence: Synthetic oligonucleotide
  Description of Combined DNA/RNA Molecule: Synthetic oligonucleotide
aggagauacaccuccaccatt

SEQ ID NO: 219 - DNA, 21 bp, Artificial Sequence
  Description of Artificial Sequence: Synthetic oligonucleotide
  Description of Combined DNA/RNA Molecule: Synthetic oligonucleotide
ugguggagguguaucuccutt

SEQ ID NO: 220 - DNA, 21 bp, Artificial Sequence
  Description of Artificial Sequence: Synthetic oligonucleotide
  Description of Combined DNA/RNA Molecule: Synthetic oligonucleotide
aggagauacaccuccaccatt

SEQ ID NO: 221 - DNA, 21 bp, Artificial Sequence
  Description of Artificial Sequence: Synthetic oligonucleotide
  Description of Combined DNA/RNA Molecule: Synthetic oligonucleotide
gguggagguguaucuccuatt

SEQ ID NO: 222 - DNA, 21 bp, Artificial Sequence
  Description of Artificial Sequence: Synthetic oligonucleotide
  Description of Combined DNA/RNA Molecule: Synthetic oligonucleotide
uaggagauacaccuccacctt

SEQ ID NO: 223 - DNA, 21 bp, Artificial Sequence
  Description of Artificial Sequence: Synthetic oligonucleotide
  Description of Combined DNA/RNA Molecule: Synthetic oligonucleotide
gguggagguguaucuccuatt

SEQ ID NO: 224 - DNA, 21 bp, Artificial Sequence
  Description of Artificial Sequence: Synthetic oligonucleotide
  Description of Combined DNA/RNA Molecule: Synthetic oligonucleotide
uaggagauacaccuccacctt

SEQ ID NO: 225 - DNA, 21 bp, Artificial Sequence
  Description of Artificial Sequence: Synthetic oligonucleotide
  Description of Combined DNA/RNA Molecule: Synthetic oligonucleotide
ggagguguaucuccuagactt

SEQ ID NO: 226 - DNA, 21 bp, Artificial Sequence
  Description of Artificial Sequence: Synthetic oligonucleotide
  Description of Combined DNA/RNA Molecule: Synthetic oligonucleotide
gucuaggagauacaccucctt

SEQ ID NO: 227 - DNA, 21 bp, Artificial Sequence
  Description of Artificial Sequence: Synthetic oligonucleotide
  Description of Combined DNA/RNA Molecule: Synthetic oligonucleotide
ggagguguaucuccuagactt

SEQ ID NO: 228 - DNA, 21 bp, Artificial Sequence
  Description of Artificial Sequence: Synthetic oligonucleotide
  Description of Combined DNA/RNA Molecule: Synthetic oligonucleotide
gucuaggagauacaccucctt

SEQ ID NO: 229 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 230 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 231 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 232 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 233 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 234 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 235 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 236 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 237 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 238 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 239 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 240 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 241 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 242 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 243 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 244 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 245 - DNA, 21 bp, Artificial Sequence
  Description of Artificial Sequence: Synthetic oligonucleotide
  Description of Combined DNA/RNA Molecule: Synthetic oligonucleotide
agguguaucuccuagacactt

SEQ ID NO: 246 - DNA, 21 bp, Artificial Sequence
  Description of Artificial Sequence: Synthetic oligonucleotide
  Description of Combined DNA/RNA Molecule: Synthetic oligonucleotide
gugucuaggagauacaccutt

SEQ ID NO: 247 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 248 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 249 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 250 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 251 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 252 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 253 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 254 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 255 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 256 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 257 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 258 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 259 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 260 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 261 - DNA, 21 bp, Artificial Sequence
  Description of Artificial Sequence: Synthetic oligonucleotide
  Description of Combined DNA/RNA Molecule: Synthetic oligonucleotide
uguaucuccuagacaccagtt

SEQ ID NO: 262 - DNA, 21 bp, Artificial Sequence
  Description of Artificial Sequence: Synthetic oligonucleotide
  Description of Combined DNA/RNA Molecule: Synthetic oligonucleotide
cuggugucuaggagauacatt

SEQ ID NO: 263 - DNA, 21 bp, Artificial Sequence
  Description of Artificial Sequence: Synthetic oligonucleotide
  Description of Combined DNA/RNA Molecule: Synthetic oligonucleotide
uguaucuccuagacaccagtt

SEQ ID NO: 264 - DNA, 21 bp, Artificial Sequence
  Description of Artificial Sequence: Synthetic oligonucleotide
  Description of Combined DNA/RNA Molecule: Synthetic oligonucleotide
cuggugucuaggagauacatt

SEQ ID NO: 265 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 266 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 267 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 268 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 269 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 270 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 271 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 272 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 273 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 274 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 275 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 276 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 277 - DNA, 21 bp, Artificial Sequence
  Description of Artificial Sequence: Synthetic oligonucleotide
  Description of Combined DNA/RNA Molecule: Synthetic oligonucleotide
ucuccuaaacaccagcauatt

SEQ ID NO: 278 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 279 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 280 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 281 - DNA, 21 bp, Artificial Sequence
  Description of Artificial Sequence: Synthetic oligonucleotide
  Description of Combined DNA/RNA Molecule: Synthetic oligonucleotide
ucuccuagacaccagcauatt

SEQ ID NO: 282 - DNA, 21 bp, Artificial Sequence
  Description of Artificial Sequence: Synthetic oligonucleotide
  Description of Combined DNA/RNA Molecule: Synthetic oligonucleotide
uaugcuggugucuaggagatt

SEQ ID NO: 283 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 284 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 285 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 286 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 287 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 288 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 289 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 290 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 291 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 292 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 293 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 294 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 295 - DNA, 21 bp, Artificial Sequence
  Description of Artificial Sequence: Synthetic oligonucleotide
  Description of Combined DNA/RNA Molecule: Synthetic oligonucleotide
aggccuggaguuuauucggtt

SEQ ID NO: 296 - DNA, 21 bp, Artificial Sequence
  Description of Artificial Sequence: Synthetic oligonucleotide
  Description of Combined DNA/RNA Molecule: Synthetic oligonucleotide
ccgaauaaacuccaggccutt

SEQ ID NO: 297 - DNA, 21 bp, Artificial Sequence
  Description of Artificial Sequence: Synthetic oligonucleotide
  Description of Combined DNA/RNA Molecule: Synthetic oligonucleotide
cuccuagacaccagcauactt

SEQ ID NO: 298 - DNA, 21 bp, Artificial Sequence
  Description of Artificial Sequence: Synthetic oligonucleotide
  Description of Combined DNA/RNA Molecule: Synthetic oligonucleotide
guaugcuggugucuaggagtt

SEQ ID NO: 299 - DNA, 21 bp, Artificial Sequence
  Description of Artificial Sequence: Synthetic oligonucleotide
  Description of Combined DNA/RNA Molecule: Synthetic oligonucleotide
cuccuagacaccagcauactt

SEQ ID NO: 300 - DNA, 21 bp, Artificial Sequence
  Description of Artificial Sequence: Synthetic oligonucleotide
  Description of Combined DNA/RNA Molecule: Synthetic oligonucleotide
guaugcuggugucuaggagtt

SEQ ID NO: 301 - DNA, 21 bp, Artificial Sequence
  Description of Artificial Sequence: Synthetic oligonucleotide
  Description of Combined DNA/RNA Molecule: Synthetic oligonucleotide
uccuagacaccagcauacatt

SEQ ID NO: 302 - DNA, 21 bp, Artificial Sequence
  Description of Artificial Sequence: Synthetic oligonucleotide
  Description of Combined DNA/RNA Molecule: Synthetic oligonucleotide
uguaugcuggugucuaggatt

SEQ ID NO: 303 - DNA, 21 bp, Artificial Sequence
  Description of Artificial Sequence: Synthetic oligonucleotide
  Description of Combined DNA/RNA Molecule: Synthetic oligonucleotide
uccuagacaccagcauacatt

SEQ ID NO: 304 - DNA, 21 bp, Artificial Sequence
  Description of Artificial Sequence: Synthetic oligonucleotide
  Description of Combined DNA/RNA Molecule: Synthetic oligonucleotide
uguaugcuggugucuaggatt

SEQ ID NO: 305 - DNA, 21 bp, Artificial Sequence
  Description of Artificial Sequence: Synthetic oligonucleotide
  Description of Combined DNA/RNA Molecule: Synthetic oligonucleotide
ccuagacaccagcauacagtt

SEQ ID NO: 306 - DNA, 21 bp, Artificial Sequence
  Description of Artificial Sequence: Synthetic oligonucleotide
  Description of Combined DNA/RNA Molecule: Synthetic oligonucleotide
cuguaugcuggugucuaggtt

SEQ ID NO: 307 - DNA, 21 bp, Artificial Sequence
  Description of Artificial Sequence: Synthetic oligonucleotide
  Description of Combined DNA/RNA Molecule: Synthetic oligonucleotide
ccuagacaccagcauacagtt

SEQ ID NO: 308 - DNA, 21 bp, Artificial Sequence
  Description of Artificial Sequence: Synthetic oligonucleotide
  Description of Combined DNA/RNA Molecule: Synthetic oligonucleotide
cuguaugcuggugucuaggtt

SEQ ID NO: 309 - DNA, 21 bp, Artificial Sequence
  Description of Artificial Sequence: Synthetic oligonucleotide
  Description of Combined DNA/RNA Molecule: Synthetic oligonucleotide
gacaccagcauacagagugtt

SEQ ID NO: 310 - DNA, 21 bp, Artificial Sequence
  Description of Artificial Sequence: Synthetic oligonucleotide
  Description of Combined DNA/RNA Molecule: Synthetic oligonucleotide
cacucuguaugcugguguctt

SEQ ID NO: 311 - DNA, 21 bp, Artificial Sequence
  Description of Artificial Sequence: Synthetic oligonucleotide
  Description of Combined DNA/RNA Molecule: Synthetic oligonucleotide
gacaccagcauacagagugtt

SEQ ID NO: 312 - DNA, 21 bp, Artificial Sequence
  Description of Artificial Sequence: Synthetic oligonucleotide
  Description of Combined DNA/RNA Molecule: Synthetic oligonucleotide
cacucuguaugcugguguctt

SEQ ID NO: 313 - DNA, 21 bp, Artificial Sequence
  Description of Artificial Sequence: Synthetic oligonucleotide
  Description of Combined DNA/RNA Molecule: Synthetic oligonucleotide
cauacagagugaccaccggtt

SEQ ID NO: 314 - DNA, 21 bp, Artificial Sequence
  Description of Artificial Sequence: Synthetic oligonucleotide
  Description of Combined DNA/RNA Molecule: Synthetic oligonucleotide
ccgguggucacucuguaugtt

SEQ ID NO: 315 - DNA, 21 bp, Artificial Sequence
  Description of Artificial Sequence: Synthetic oligonucleotide
  Description of Combined DNA/RNA Molecule: Synthetic oligonucleotide
cauacagagugaccaccggtt

SEQ ID NO: 316 - DNA, 21 bp, Artificial Sequence
  Description of Artificial Sequence: Synthetic oligonucleotide
  Description of Combined DNA/RNA Molecule: Synthetic oligonucleotide
ccgguggucacucuguaugtt

SEQ ID NO: 317 - DNA, 21 bp, Artificial Sequence
  Description of Artificial Sequence: Synthetic oligonucleotide
  Description of Combined DNA/RNA Molecule: Synthetic oligonucleotide
agagugaccaccgggaaautt

SEQ ID NO: 318 - DNA, 21 bp, Artificial Sequence
  Description of Artificial Sequence: Synthetic oligonucleotide
  Description of Combined DNA/RNA Molecule: Synthetic oligonucleotide
auuucccgguggucacucutt

SEQ ID NO: 319 - DNA, 21 bp, Artificial Sequence
  Description of Artificial Sequence: Synthetic oligonucleotide
  Description of Combined DNA/RNA Molecule: Synthetic oligonucleotide
agagugaccaccgggaaautt

SEQ ID NO: 320 - DNA, 21 bp, Artificial Sequence
  Description of Artificial Sequence: Synthetic oligonucleotide
  Description of Combined DNA/RNA Molecule: Synthetic oligonucleotide
auuucccgguggucacucutt

SEQ ID NO: 321 - DNA, 21 bp, Artificial Sequence
  Description of Artificial Sequence: Synthetic oligonucleotide
  Description of Combined DNA/RNA Molecule: Synthetic oligonucleotide
gagugaccaccgggaaauctt

SEQ ID NO: 322 - DNA, 21 bp, Artificial Sequence
  Description of Artificial Sequence: Synthetic oligonucleotide
  Description of Combined DNA/RNA Molecule: Synthetic oligonucleotide
gauuucccgguggucacuctt

SEQ ID NO: 323 - DNA, 21 bp, Artificial Sequence
  Description of Artificial Sequence: Synthetic oligonucleotide
  Description of Combined DNA/RNA Molecule: Synthetic oligonucleotide
gagugaccaccgggaaauctt

SEQ ID NO: 324 - DNA, 21 bp, Artificial Sequence
  Description of Artificial Sequence: Synthetic oligonucleotide
  Description of Combined DNA/RNA Molecule: Synthetic oligonucleotide
gauuucccgguggucacuctt

SEQ ID NO: 325 - DNA, 21 bp, Artificial Sequence
  Description of Artificial Sequence: Synthetic oligonucleotide
  Description of Combined DNA/RNA Molecule: Synthetic oligonucleotide
gugaccaccgggaaaucgatt

SEQ ID NO: 326 - DNA, 21 bp, Artificial Sequence
  Description of Artificial Sequence: Synthetic oligonucleotide
  Description of Combined DNA/RNA Molecule: Synthetic oligonucleotide
ucgauuucccgguggucactt

SEQ ID NO: 327 - DNA, 21 bp, Artificial Sequence
  Description of Artificial Sequence: Synthetic oligonucleotide
  Description of Combined DNA/RNA Molecule: Synthetic oligonucleotide
gugaccaccgggaaaucgatt

SEQ ID NO: 328 - DNA, 21 bp, Artificial Sequence
  Description of Artificial Sequence: Synthetic oligonucleotide
  Description of Combined DNA/RNA Molecule: Synthetic oligonucleotide
ucgauuucccgguggucactt

SEQ ID NO: 329 - DNA, 21 bp, Artificial Sequence
  Description of Artificial Sequence: Synthetic oligonucleotide
  Description of Combined DNA/RNA Molecule: Synthetic oligonucleotide
gaccaccgggaaaucgaggtt

SEQ ID NO: 330 - DNA, 21 bp, Artificial Sequence
  Description of Artificial Sequence: Synthetic oligonucleotide
  Description of Combined DNA/RNA Molecule: Synthetic oligonucleotide
ccucgauuucccggugguctt

SEQ ID NO: 331 - DNA, 21 bp, Artificial Sequence
  Description of Artificial Sequence: Synthetic oligonucleotide
  Description of Combined DNA/RNA Molecule: Synthetic oligonucleotide
gaccaccgggaaaucgaggtt

SEQ ID NO: 332 - DNA, 21 bp, Artificial Sequence
  Description of Artificial Sequence: Synthetic oligonucleotide
  Description of Combined DNA/RNA Molecule: Synthetic oligonucleotide
ccucgauuucccggugguctt

SEQ ID NO: 333 - DNA, 21 bp, Artificial Sequence
  Description of Artificial Sequence: Synthetic oligonucleotide
  Description of Combined DNA/RNA Molecule: Synthetic oligonucleotide
accaccgggaaaucgagggtt

SEQ ID NO: 334 - DNA, 21 bp, Artificial Sequence
  Description of Artificial Sequence: Synthetic oligonucleotide
  Description of Combined DNA/RNA Molecule: Synthetic oligonucleotide
cccucgauuucccgguggutt

SEQ ID NO: 335 - DNA, 21 bp, Artificial Sequence
  Description of Artificial Sequence: Synthetic oligonucleotide
  Description of Combined DNA/RNA Molecule: Synthetic oligonucleotide
accaccgggaaaucgagggtt

SEQ ID NO: 336 - DNA, 21 bp, Artificial Sequence
  Description of Artificial Sequence: Synthetic oligonucleotide
  Description of Combined DNA/RNA Molecule: Synthetic oligonucleotide
cccucgauuucccgguggutt

SEQ ID NO: 337 - DNA, 21 bp, Artificial Sequence
  Description of Artificial Sequence: Synthetic oligonucleotide
  Description of Combined DNA/RNA Molecule: Synthetic oligonucleotide
ccaccgggaaaucgagggctt

SEQ ID NO: 338 - DNA, 21 bp, Artificial Sequence
  Description of Artificial Sequence: Synthetic oligonucleotide
  Description of Combined DNA/RNA Molecule: Synthetic oligonucleotide
gcccucgauuucccgguggtt

SEQ ID NO: 339 - DNA, 21 bp, Artificial Sequence
  Description of Artificial Sequence: Synthetic oligonucleotide
  Description of Combined DNA/RNA Molecule: Synthetic oligonucleotide
ccaccgggaaaucgagggctt

SEQ ID NO: 340 - DNA, 21 bp, Artificial Sequence
  Description of Artificial Sequence: Synthetic oligonucleotide
  Description of Combined DNA/RNA Molecule: Synthetic oligonucleotide
gcccucgauuucccgguggtt

SEQ ID NO: 341 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 342 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 343 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 344 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 345 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 346 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 347 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 348 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 349 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 350 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 351 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 352 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 353 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 354 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 355 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 356 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 357 - DNA, 21 bp, Artificial Sequence
  Description of Artificial Sequence: Synthetic oligonucleotide
  Description of Combined DNA/RNA Molecule: Synthetic oligonucleotide
aaaucgagggcagggucautt

SEQ ID NO: 358 - DNA, 21 bp, Artificial Sequence
  Description of Artificial Sequence: Synthetic oligonucleotide
  Description of Combined DNA/RNA Molecule: Synthetic oligonucleotide
augacccugcccucgauuutt

SEQ ID NO: 359 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 360 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 361 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 362 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 363 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 364 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 365 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 366 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 367 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 368 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 369 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 370 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 371 - DNA, 21 bp, Artificial Sequence
  Description of Artificial Sequence: Synthetic oligonucleotide
  Description of Combined DNA/RNA Molecule: Synthetic oligonucleotide
cggcacccucauaggccugtt

SEQ ID NO: 372 - DNA, 21 bp, Artificial Sequence
  Description of Artificial Sequence: Synthetic oligonucleotide
  Description of Combined DNA/RNA Molecule: Synthetic oligonucleotide
caggccuaugagggugccgtt

SEQ ID NO: 373 - DNA, 21 bp, Artificial Sequence
  Description of Artificial Sequence: Synthetic oligonucleotide
  Description of Combined DNA/RNA Molecule: Synthetic oligonucleotide
aucgagggcagggucauggtt

SEQ ID NO: 374 - DNA, 21 bp, Artificial Sequence
  Description of Artificial Sequence: Synthetic oligonucleotide
  Description of Combined DNA/RNA Molecule: Synthetic oligonucleotide
ccaugacccugcccucgautt

SEQ ID NO: 375 - DNA, 21 bp, Artificial Sequence
  Description of Artificial Sequence: Synthetic oligonucleotide
  Description of Combined DNA/RNA Molecule: Synthetic oligonucleotide
aucgagggcagggucauggtt

SEQ ID NO: 376 - DNA, 21 bp, Artificial Sequence
  Description of Artificial Sequence: Synthetic oligonucleotide
  Description of Combined DNA/RNA Molecule: Synthetic oligonucleotide
ccaugacccugcccucgautt

SEQ ID NO: 377 - DNA, 21 bp, Artificial Sequence
  Description of Artificial Sequence: Synthetic oligonucleotide
  Description of Combined DNA/RNA Molecule: Synthetic oligonucleotide
cgagggcagggucaugguctt

SEQ ID NO: 378 - DNA, 21 bp, Artificial Sequence
  Description of Artificial Sequence: Synthetic oligonucleotide
  Description of Combined DNA/RNA Molecule: Synthetic oligonucleotide
gaccaugacccugcccucgtt

SEQ ID NO: 379 - DNA, 21 bp, Artificial Sequence
  Description of Artificial Sequence: Synthetic oligonucleotide
  Description of Combined DNA/RNA Molecule: Synthetic oligonucleotide
gagggcagggucauggucatt

SEQ ID NO: 380 - DNA, 21 bp, Artificial Sequence
  Description of Artificial Sequence: Synthetic oligonucleotide
  Description of Combined DNA/RNA Molecule: Synthetic oligonucleotide
ugaccaugacccugcccuctt

SEQ ID NO: 381 - DNA, 21 bp, Artificial Sequence
  Description of Artificial Sequence: Synthetic oligonucleotide
  Description of Combined DNA/RNA Molecule: Synthetic oligonucleotide
gagggcagggucauggucatt

SEQ ID NO: 382 - DNA, 21 bp, Artificial Sequence
  Description of Artificial Sequence: Synthetic oligonucleotide
  Description of Combined DNA/RNA Molecule: Synthetic oligonucleotide
ugaccaugacccugcccuctt

SEQ ID NO: 383 - DNA, 21 bp, Artificial Sequence
  Description of Artificial Sequence: Synthetic oligonucleotide
  Description of Combined DNA/RNA Molecule: Synthetic oligonucleotide
gggcagggucauggucacctt

SEQ ID NO: 384 - DNA, 21 bp, Artificial Sequence
  Description of Artificial Sequence: Synthetic oligonucleotide
  Description of Combined DNA/RNA Molecule: Synthetic oligonucleotide
ggugaccaugacccugccctt

SEQ ID NO: 385 - DNA, 21 bp, Artificial Sequence
  Description of Artificial Sequence: Synthetic oligonucleotide
  Description of Combined DNA/RNA Molecule: Synthetic oligonucleotide
gggcagggucauggucacctt

SEQ ID NO: 386 - DNA, 21 bp, Artificial Sequence
  Description of Artificial Sequence: Synthetic oligonucleotide
  Description of Combined DNA/RNA Molecule: Synthetic oligonucleotide
ggugaccaugacccugccctt

SEQ ID NO: 387 - DNA, 21 bp, Artificial Sequence
  Description of Artificial Sequence: Synthetic oligonucleotide
  Description of Combined DNA/RNA Molecule: Synthetic oligonucleotide
cagggucauggucaccgactt

SEQ ID NO: 388 - DNA, 21 bp, Artificial Sequence
  Description of Artificial Sequence: Synthetic oligonucleotide
  Description of Combined DNA/RNA Molecule: Synthetic oligonucleotide
gucggugaccaugacccugtt

SEQ ID NO: 389 - DNA, 21 bp, Artificial Sequence
  Description of Artificial Sequence: Synthetic oligonucleotide
  Description of Combined DNA/RNA Molecule: Synthetic oligonucleotide
cagggucauggucaccgactt

SEQ ID NO: 390 - DNA, 21 bp, Artificial Sequence
  Description of Artificial Sequence: Synthetic oligonucleotide
  Description of Combined DNA/RNA Molecule: Synthetic oligonucleotide
gucggugaccaugacccugtt

SEQ ID NO: 391 - DNA, 21 bp, Artificial Sequence
  Description of Artificial Sequence: Synthetic oligonucleotide
  Description of Combined DNA/RNA Molecule: Synthetic oligonucleotide
agggucauggucaccgacutt

SEQ ID NO: 392 - DNA, 21 bp, Artificial Sequence
  Description of Artificial Sequence: Synthetic oligonucleotide
  Description of Combined DNA/RNA Molecule: Synthetic oligonucleotide
agucggugaccaugacccutt

SEQ ID NO: 393 - DNA, 21 bp, Artificial Sequence
  Description of Artificial Sequence: Synthetic oligonucleotide
  Description of Combined DNA/RNA Molecule: Synthetic oligonucleotide
agggucauggucaccgacutt

SEQ ID NO: 394 - DNA, 21 bp, Artificial Sequence
  Description of Artificial Sequence: Synthetic oligonucleotide
  Description of Combined DNA/RNA Molecule: Synthetic oligonucleotide
agucggugaccaugacccutt

SEQ ID NO: 395 - DNA, 21 bp, Artificial Sequence
  Description of Artificial Sequence: Synthetic oligonucleotide
  Description of Combined DNA/RNA Molecule: Synthetic oligonucleotide
auggucaccgacuucgagatt

SEQ ID NO: 396 - DNA, 21 bp, Artificial Sequence
  Description of Artificial Sequence: Synthetic oligonucleotide
  Description of Combined DNA/RNA Molecule: Synthetic oligonucleotide
ucucgaagucggugaccautt

SEQ ID NO: 397 - DNA, 21 bp, Artificial Sequence
  Description of Artificial Sequence: Synthetic oligonucleotide
  Description of Combined DNA/RNA Molecule: Synthetic oligonucleotide
auggucaccgacuucgagatt

SEQ ID NO: 398 - DNA, 21 bp, Artificial Sequence
  Description of Artificial Sequence: Synthetic oligonucleotide
  Description of Combined DNA/RNA Molecule: Synthetic oligonucleotide
ucucgaagucggugaccautt

SEQ ID NO: 399 - DNA, 21 bp, Artificial Sequence
  Description of Artificial Sequence: Synthetic oligonucleotide
  Description of Combined DNA/RNA Molecule: Synthetic oligonucleotide
ccgacuucgagaaugugcctt

SEQ ID NO: 400 - DNA, 21 bp, Artificial Sequence
  Description of Artificial Sequence: Synthetic oligonucleotide
  Description of Combined DNA/RNA Molecule: Synthetic oligonucleotide
ggcacauucucgaagucggtt

SEQ ID NO: 401 - DNA, 21 bp, Artificial Sequence
  Description of Artificial Sequence: Synthetic oligonucleotide
  Description of Combined DNA/RNA Molecule: Synthetic oligonucleotide
ggaggacgggacccgcuuctt

SEQ ID NO: 402 - DNA, 21 bp, Artificial Sequence
  Description of Artificial Sequence: Synthetic oligonucleotide
  Description of Combined DNA/RNA Molecule: Synthetic oligonucleotide
gaagcgggucccguccucctt

SEQ ID NO: 403 - DNA, 21 bp, Artificial Sequence
  Description of Artificial Sequence: Synthetic oligonucleotide
  Description of Combined DNA/RNA Molecule: Synthetic oligonucleotide
cagcggccgggaugccggctt

SEQ ID NO: 404 - DNA, 21 bp, Artificial Sequence
  Description of Artificial Sequence: Synthetic oligonucleotide
  Description of Combined DNA/RNA Molecule: Synthetic oligonucleotide
gccggcaucccggccgcugtt

SEQ ID NO: 405 - DNA, 21 bp, Artificial Sequence
  Description of Artificial Sequence: Synthetic oligonucleotide
  Description of Combined DNA/RNA Molecule: Synthetic oligonucleotide
cagcggccgggaugccggctt

SEQ ID NO: 406 - DNA, 21 bp, Artificial Sequence
  Description of Artificial Sequence: Synthetic oligonucleotide
  Description of Combined DNA/RNA Molecule: Synthetic oligonucleotide
gccggcaucccggccgcugtt

SEQ ID NO: 407 - DNA, 21 bp, Artificial Sequence
  Description of Artificial Sequence: Synthetic oligonucleotide
  Description of Combined DNA/RNA Molecule: Synthetic oligonucleotide
gggugccagcaugcgcagctt

SEQ ID NO: 408 - DNA, 21 bp, Artificial Sequence
  Description of Artificial Sequence: Synthetic oligonucleotide
  Description of Combined DNA/RNA Molecule: Synthetic oligonucleotide
gcugcgcaugcuggcaccctt

SEQ ID NO: 409 - DNA, 21 bp, Artificial Sequence
  Description of Artificial Sequence: Synthetic oligonucleotide
  Description of Combined DNA/RNA Molecule: Synthetic oligonucleotide
ccugcgcgugcucaacugctt

SEQ ID NO: 410 - DNA, 21 bp, Artificial Sequence
  Description of Artificial Sequence: Synthetic oligonucleotide
  Description of Combined DNA/RNA Molecule: Synthetic oligonucleotide
gcaguugagcacgcgcaggtt

SEQ ID NO: 411 - DNA, 21 bp, Artificial Sequence
  Description of Artificial Sequence: Synthetic oligonucleotide
  Description of Combined DNA/RNA Molecule: Synthetic oligonucleotide
ccugcgcgugcucaacugctt

SEQ ID NO: 412 - DNA, 21 bp, Artificial Sequence
  Description of Artificial Sequence: Synthetic oligonucleotide
  Description of Combined DNA/RNA Molecule: Synthetic oligonucleotide
gcaguugagcacgcgcaggtt

SEQ ID NO: 413 - DNA, 21 bp, Artificial Sequence
  Description of Artificial Sequence: Synthetic oligonucleotide
  Description of Combined DNA/RNA Molecule: Synthetic oligonucleotide
ugcgcgugcucaacugccatt

SEQ ID NO: 414 - DNA, 21 bp, Artificial Sequence
  Description of Artificial Sequence: Synthetic oligonucleotide
  Description of Combined DNA/RNA Molecule: Synthetic oligonucleotide
uggcaguugagcacgcgcatt

SEQ ID NO: 415 - DNA, 21 bp, Artificial Sequence
  Description of Artificial Sequence: Synthetic oligonucleotide
  Description of Combined DNA/RNA Molecule: Synthetic oligonucleotide
ugcgcgugcucaacugccatt

SEQ ID NO: 416 - DNA, 21 bp, Artificial Sequence
  Description of Artificial Sequence: Synthetic oligonucleotide
  Description of Combined DNA/RNA Molecule: Synthetic oligonucleotide
uggcaguugagcacgcgcatt

SEQ ID NO: 417 - DNA, 21 bp, Artificial Sequence
  Description of Artificial Sequence: Synthetic oligonucleotide
  Description of Combined DNA/RNA Molecule: Synthetic oligonucleotide
cgcgugcucaacugccaagtt

SEQ ID NO: 418 - DNA, 21 bp, Artificial Sequence
  Description of Artificial Sequence: Synthetic oligonucleotide
  Description of Combined DNA/RNA Molecule: Synthetic oligonucleotide
cuuggcaguugagcacgcgtt

SEQ ID NO: 419 - DNA, 21 bp, Artificial Sequence
  Description of Artificial Sequence: Synthetic oligonucleotide
  Description of Combined DNA/RNA Molecule: Synthetic oligonucleotide
cgcgugcucaacugccaagtt

SEQ ID NO: 420 - DNA, 21 bp, Artificial Sequence
  Description of Artificial Sequence: Synthetic oligonucleotide
  Description of Combined DNA/RNA Molecule: Synthetic oligonucleotide
cuuggcaguugagcacgcgtt

SEQ ID NO: 421 - DNA, 21 bp, Artificial Sequence
  Description of Artificial Sequence: Synthetic oligonucleotide
  Description of Combined DNA/RNA Molecule: Synthetic oligonucleotide
cugccaagggaagggcacgtt

SEQ ID NO: 422 - DNA, 21 bp, Artificial Sequence
  Description of Artificial Sequence: Synthetic oligonucleotide
  Description of Combined DNA/RNA Molecule: Synthetic oligonucleotide
cgugcccuucccuuggcagtt

SEQ ID NO: 423 - DNA, 21 bp, Artificial Sequence
  Description of Artificial Sequence: Synthetic oligonucleotide
  Description of Combined DNA/RNA Molecule: Synthetic oligonucleotide
cugccaagggaagggcacgtt

SEQ ID NO: 424 - DNA, 21 bp, Artificial Sequence
  Description of Artificial Sequence: Synthetic oligonucleotide
  Description of Combined DNA/RNA Molecule: Synthetic oligonucleotide
cgugcccuucccuuggcagtt

SEQ ID NO: 425 - DNA, 21 bp, Artificial Sequence
  Description of Artificial Sequence: Synthetic oligonucleotide
  Description of Combined DNA/RNA Molecule: Synthetic oligonucleotide
caagggaagggcacgguuatt

SEQ ID NO: 426 - DNA, 21 bp, Artificial Sequence
  Description of Artificial Sequence: Synthetic oligonucleotide
  Description of Combined DNA/RNA Molecule: Synthetic oligonucleotide
uaaccgugcccuucccuugtt

SEQ ID NO: 427 - DNA, 21 bp, Artificial Sequence
  Description of Artificial Sequence: Synthetic oligonucleotide
  Description of Combined DNA/RNA Molecule: Synthetic oligonucleotide
aagggaagggcacgguuagtt

SEQ ID NO: 428 - DNA, 21 bp, Artificial Sequence
  Description of Artificial Sequence: Synthetic oligonucleotide
  Description of Combined DNA/RNA Molecule: Synthetic oligonucleotide
cuaaccgugcccuucccuutt

SEQ ID NO: 429 - DNA, 21 bp, Artificial Sequence
  Description of Artificial Sequence: Synthetic oligonucleotide
  Description of Combined DNA/RNA Molecule: Synthetic oligonucleotide
agggaagggcacgguuagctt

SEQ ID NO: 430 - DNA, 21 bp, Artificial Sequence
  Description of Artificial Sequence: Synthetic oligonucleotide
  Description of Combined DNA/RNA Molecule: Synthetic oligonucleotide
gcuaaccgugcccuucccutt

SEQ ID NO: 431 - DNA, 21 bp, Artificial Sequence
  Description of Artificial Sequence: Synthetic oligonucleotide
  Description of Combined DNA/RNA Molecule: Synthetic oligonucleotide
gggaagggcacgguuagcgtt

SEQ ID NO: 432 - DNA, 21 bp, Artificial Sequence
  Description of Artificial Sequence: Synthetic oligonucleotide
  Description of Combined DNA/RNA Molecule: Synthetic oligonucleotide
cgcuaaccgugcccuuccctt

SEQ ID NO: 433 - DNA, 21 bp, Artificial Sequence
  Description of Artificial Sequence: Synthetic oligonucleotide
  Description of Combined DNA/RNA Molecule: Synthetic oligonucleotide
ggaagggcacgguuagcggtt

SEQ ID NO: 434 - DNA, 21 bp, Artificial Sequence
  Description of Artificial Sequence: Synthetic oligonucleotide
  Description of Combined DNA/RNA Molecule: Synthetic oligonucleotide
ccgcuaaccgugcccuucctt

SEQ ID NO: 435 - DNA, 21 bp, Artificial Sequence
  Description of Artificial Sequence: Synthetic oligonucleotide
  Description of Combined DNA/RNA Molecule: Synthetic oligonucleotide
gaagggcacgguuagcggctt

SEQ ID NO: 436 - DNA, 21 bp, Artificial Sequence
  Description of Artificial Sequence: Synthetic oligonucleotide
  Description of Combined DNA/RNA Molecule: Synthetic oligonucleotide
gccgcuaaccgugcccuuctt

SEQ ID NO: 437 - DNA, 21 bp, Artificial Sequence
  Description of Artificial Sequence: Synthetic oligonucleotide
  Description of Combined DNA/RNA Molecule: Synthetic oligonucleotide
aagggcacgguuagcggcatt

SEQ ID NO: 438 - DNA, 21 bp, Artificial Sequence
  Description of Artificial Sequence: Synthetic oligonucleotide
  Description of Combined DNA/RNA Molecule: Synthetic oligonucleotide
ugccgcuaaccgugcccuutt

SEQ ID NO: 439 - DNA, 21 bp, Artificial Sequence
  Description of Artificial Sequence: Synthetic oligonucleotide
  Description of Combined DNA/RNA Molecule: Synthetic oligonucleotide
agggcacgguuagcggcactt

SEQ ID NO: 440 - DNA, 21 bp, Artificial Sequence
  Description of Artificial Sequence: Synthetic oligonucleotide
  Description of Combined DNA/RNA Molecule: Synthetic oligonucleotide
gugccgcuaaccgugcccutt

SEQ ID NO: 441 - DNA, 21 bp, Artificial Sequence
  Description of Artificial Sequence: Synthetic oligonucleotide
  Description of Combined DNA/RNA Molecule: Synthetic oligonucleotide
cacgguuagcggcacccuctt

SEQ ID NO: 442 - DNA, 21 bp, Artificial Sequence
  Description of Artificial Sequence: Synthetic oligonucleotide
  Description of Combined DNA/RNA Molecule: Synthetic oligonucleotide
gagggugccgcuaaccgugtt

SEQ ID NO: 443 - DNA, 21 bp, Artificial Sequence
  Description of Artificial Sequence: Synthetic oligonucleotide
  Description of Combined DNA/RNA Molecule: Synthetic oligonucleotide
acgguuagcggcacccucatt

SEQ ID NO: 444 - DNA, 21 bp, Artificial Sequence
  Description of Artificial Sequence: Synthetic oligonucleotide
  Description of Combined DNA/RNA Molecule: Synthetic oligonucleotide
ugagggugccgcuaaccgutt

SEQ ID NO: 445 - DNA, 21 bp, Artificial Sequence
  Description of Artificial Sequence: Synthetic oligonucleotide
  Description of Combined DNA/RNA Molecule: Synthetic oligonucleotide
guuagcggcacccucauagtt

SEQ ID NO: 446 - DNA, 21 bp, Artificial Sequence
  Description of Artificial Sequence: Synthetic oligonucleotide
  Description of Combined DNA/RNA Molecule: Synthetic oligonucleotide
cuaugagggugccgcuaactt

SEQ ID NO: 447 - DNA, 21 bp, Artificial Sequence
  Description of Artificial Sequence: Synthetic oligonucleotide
  Description of Combined DNA/RNA Molecule: Synthetic oligonucleotide
uuagcggcacccucauaggtt

SEQ ID NO: 448 - DNA, 21 bp, Artificial Sequence
  Description of Artificial Sequence: Synthetic oligonucleotide
  Description of Combined DNA/RNA Molecule: Synthetic oligonucleotide
ccuaugagggugccgcuaatt

SEQ ID NO: 449 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 450 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 451 - DNA, 21 bp, Artificial Sequence
  Description of Artificial Sequence: Synthetic oligonucleotide
  Description of Combined DNA/RNA Molecule: Synthetic oligonucleotide
gcacccucauaggccuggatt

SEQ ID NO: 452 - DNA, 21 bp, Artificial Sequence
  Description of Artificial Sequence: Synthetic oligonucleotide
  Description of Combined DNA/RNA Molecule: Synthetic oligonucleotide
uccaggccuaugagggugctt

SEQ ID NO: 453 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 454 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 455 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 456 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 457 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 458 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 461 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 462 - DNA, 20 bp, Artificial Sequence
  Description of Artificial Sequence: Synthetic oligonucleotide
  Description of Combined DNA/RNA Molecule: Synthetic oligonucleotide
uuccgaauaacuccaggctt

SEQ ID NO: 463 - DNA, 21 bp, Artificial Sequence
  Description of Artificial Sequence: Synthetic oligonucleotide
  Description of Combined DNA/RNA Molecule: Synthetic oligonucleotide
cuggaguuuauucggaaaatt

SEQ ID NO: 464 - DNA, 21 bp, Artificial Sequence
  Description of Artificial Sequence: Synthetic oligonucleotide
  Description of Combined DNA/RNA Molecule: Synthetic oligonucleotide
uuuuccgaauaaacuccagtt

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
cuggaguuuauucggaaaatt

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
uuuuccgaauaaacuccagtt

SEQ ID NO: 467 - DNA, 21 bp, Artificial Sequence
  Description of Artificial Sequence: Synthetic oligonucleotide
  Description of Combined DNA/RNA Molecule: Synthetic oligonucleotide
ggaguuuauucggaaaagctt

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
gcuuuuccgaauaaacucctt

SEQ ID NO: 469 - DNA, 21 bp, Artificial Sequence
  Description of Artificial Sequence: Synthetic oligonucleotide
  Description of Combined DNA/RNA Molecule: Synthetic oligonucleotide
ggaguuuauucggaaaagctt

SEQ ID NO: 470 - DNA, 21 bp, Artificial Sequence
  Description of Artificial Sequence: Synthetic oligonucleotide
  Description of Combined DNA/RNA Molecule: Synthetic oligonucleotide
gcuuuuccgaauaaacucctt

SEQ ID NO: 471 - DNA, 21 bp, Artificial Sequence
  Description of Artificial Sequence: Synthetic oligonucleotide
  Description of Combined DNA/RNA Molecule: Synthetic oligonucleotide
gaguuuauucggaaaagcctt

SEQ ID NO: 472 - DNA, 21 bp, Artificial Sequence
  Description of Artificial Sequence: Synthetic oligonucleotide
  Description of Combined DNA/RNA Molecule: Synthetic oligonucleotide
ggcuuuuccgaauaaacuctt

SEQ ID NO: 473 - DNA, 21 bp, Artificial Sequence
  Description of Artificial Sequence: Synthetic oligonucleotide
  Description of Combined DNA/RNA Molecule: Synthetic oligonucleotide
gaguuuauucggaaaagcctt

SEQ ID NO: 474 - DNA, 21 bp, Artificial Sequence
  Description of Artificial Sequence: Synthetic oligonucleotide
  Description of Combined DNA/RNA Molecule: Synthetic oligonucleotide
ggcuuuuccgaauaaacuctt

SEQ ID NO: 475 - DNA, 21 bp, Artificial Sequence
  Description of Artificial Sequence: Synthetic oligonucleotide
  Description of Combined DNA/RNA Molecule: Synthetic oligonucleotide
uuauucggaaaagccagcutt

SEQ ID NO: 476 - DNA, 21 bp, Artificial Sequence
  Description of Artificial Sequence: Synthetic oligonucleotide
  Description of Combined DNA/RNA Molecule: Synthetic oligonucleotide
agcuggcuuuuccgaauaatt

SEQ ID NO: 477 - DNA, 21 bp, Artificial Sequence
  Description of Artificial Sequence: Synthetic oligonucleotide
  Description of Combined DNA/RNA Molecule: Synthetic oligonucleotide
uuauucggaaaagccagcutt

SEQ ID NO: 478 - DNA, 21 bp, Artificial Sequence
  Description of Artificial Sequence: Synthetic oligonucleotide
  Description of Combined DNA/RNA Molecule: Synthetic oligonucleotide
agcuggcuuuuccgaauaatt

SEQ ID NO: 479 - DNA, 21 bp, Artificial Sequence
  Description of Artificial Sequence: Synthetic oligonucleotide
  Description of Combined DNA/RNA Molecule: Synthetic oligonucleotide
cccuggcggguggguacagtt

SEQ ID NO: 480 - DNA, 21 bp, Artificial Sequence
  Description of Artificial Sequence: Synthetic oligonucleotide
  Description of Combined DNA/RNA Molecule: Synthetic oligonucleotide
cuguacccacccgccagggtt

SEQ ID NO: 481 - DNA, 21 bp, Artificial Sequence
  Description of Artificial Sequence: Synthetic oligonucleotide
  Description of Combined DNA/RNA Molecule: Synthetic oligonucleotide
cccuggcggguggguacagtt

SEQ ID NO: 482 - DNA, 21 bp, Artificial Sequence
  Description of Artificial Sequence: Synthetic oligonucleotide
  Description of Combined DNA/RNA Molecule: Synthetic oligonucleotide
cuguacccacccgccagggtt

SEQ ID NO: 483 - DNA, 21 bp, Artificial Sequence
  Description of Artificial Sequence: Synthetic oligonucleotide
  Description of Combined DNA/RNA Molecule: Synthetic oligonucleotide
ccuggcggguggguacagctt

SEQ ID NO: 484 - DNA, 21 bp, Artificial Sequence
  Description of Artificial Sequence: Synthetic oligonucleotide
  Description of Combined DNA/RNA Molecule: Synthetic oligonucleotide
gcuguacccacccgccaggtt

SEQ ID NO: 485 - DNA, 21 bp, Artificial Sequence
  Description of Artificial Sequence: Synthetic oligonucleotide
  Description of Combined DNA/RNA Molecule: Synthetic oligonucleotide
uggcggguggguacagccgtt

SEQ ID NO: 486 - DNA, 21 bp, Artificial Sequence
  Description of Artificial Sequence: Synthetic oligonucleotide
  Description of Combined DNA/RNA Molecule: Synthetic oligonucleotide
cggcuguacccacccgccatt

SEQ ID NO: 487 - DNA, 21 bp, Artificial Sequence
  Description of Artificial Sequence: Synthetic oligonucleotide
  Description of Combined DNA/RNA Molecule: Synthetic oligonucleotide
uggcggguggguacagccgtt

SEQ ID NO: 488 - DNA, 21 bp, Artificial Sequence
  Description of Artificial Sequence: Synthetic oligonucleotide
  Description of Combined DNA/RNA Molecule: Synthetic oligonucleotide
cggcuguacccacccgccatt

SEQ ID NO: 489 - DNA, 21 bp, Artificial Sequence
  Description of Artificial Sequence: Synthetic oligonucleotide
  Description of Combined DNA/RNA Molecule: Synthetic oligonucleotide
ggcggguggguacagccgctt

SEQ ID NO: 490 - DNA, 21 bp, Artificial Sequence
  Description of Artificial Sequence: Synthetic oligonucleotide
  Description of Combined DNA/RNA Molecule: Synthetic oligonucleotide
gcggcuguacccacccgcctt

SEQ ID NO: 491 - DNA, 21 bp, Artificial Sequence
  Description of Artificial Sequence: Synthetic oligonucleotide
  Description of Combined DNA/RNA Molecule: Synthetic oligonucleotide
gguggguacagccgcgucctt

SEQ ID NO: 492 - DNA, 21 bp, Artificial Sequence
  Description of Artificial Sequence: Synthetic oligonucleotide
  Description of Combined DNA/RNA Molecule: Synthetic oligonucleotide
ggacgcggcuguacccacctt

SEQ ID NO: 493 - DNA, 21 bp, Artificial Sequence
  Description of Artificial Sequence: Synthetic oligonucleotide
  Description of Combined DNA/RNA Molecule: Synthetic oligonucleotide
uggguacagccgcguccuctt

SEQ ID NO: 494 - DNA, 21 bp, Artificial Sequence
  Description of Artificial Sequence: Synthetic oligonucleotide
  Description of Combined DNA/RNA Molecule: Synthetic oligonucleotide
gaggacgcggcuguacccatt

SEQ ID NO: 495 - DNA, 21 bp, Artificial Sequence
  Description of Artificial Sequence: Synthetic oligonucleotide
  Description of Combined DNA/RNA Molecule: Synthetic oligonucleotide
gccgcguccucaacgccgctt

SEQ ID NO: 496 - DNA, 21 bp, Artificial Sequence
  Description of Artificial Sequence: Synthetic oligonucleotide
  Description of Combined DNA/RNA Molecule: Synthetic oligonucleotide
gcggcguugaggacgcggctt

SEQ ID NO: 497 - DNA, 21 bp, Artificial Sequence
  Description of Artificial Sequence: Synthetic oligonucleotide
  Description of Combined DNA/RNA Molecule: Synthetic oligonucleotide
ccgcguccucaacgccgcctt

SEQ ID NO: 498 - DNA, 21 bp, Artificial Sequence
  Description of Artificial Sequence: Synthetic oligonucleotide
  Description of Combined DNA/RNA Molecule: Synthetic oligonucleotide
ggcggcguugaggacgcggtt

SEQ ID NO: 499 - DNA, 21 bp, Artificial Sequence
  Description of Artificial Sequence: Synthetic oligonucleotide
  Description of Combined DNA/RNA Molecule: Synthetic oligonucleotide
gucgugcuggucaccgcugtt

SEQ ID NO: 500 - DNA, 21 bp, Artificial Sequence
  Description of Artificial Sequence: Synthetic oligonucleotide
  Description of Combined DNA/RNA Molecule: Synthetic oligonucleotide
cagcggugaccagcacgactt

SEQ ID NO: 501 - DNA, 21 bp, Artificial Sequence
  Description of Artificial Sequence: Synthetic oligonucleotide
  Description of Combined DNA/RNA Molecule: Synthetic oligonucleotide
gucgugcuggucaccgcugtt

SEQ ID NO: 502 - DNA, 21 bp, Artificial Sequence
  Description of Artificial Sequence: Synthetic oligonucleotide
  Description of Combined DNA/RNA Molecule: Synthetic oligonucleotide
cagcggugaccagcacgactt

SEQ ID NO: 503 - DNA, 21 bp, Artificial Sequence
  Description of Artificial Sequence: Synthetic oligonucleotide
  Description of Combined DNA/RNA Molecule: Synthetic oligonucleotide
ucgugcuggucaccgcugctt

SEQ ID NO: 504 - DNA, 21 bp, Artificial Sequence
  Description of Artificial Sequence: Synthetic oligonucleotide
  Description of Combined DNA/RNA Molecule: Synthetic oligonucleotide
gcagcggugaccagcacgatt

SEQ ID NO: 505 - DNA, 21 bp, Artificial Sequence
  Description of Artificial Sequence: Synthetic oligonucleotide
  Description of Combined DNA/RNA Molecule: Synthetic oligonucleotide
ucgugcuggucaccgcugctt

SEQ ID NO: 506 - DNA, 21 bp, Artificial Sequence
  Description of Artificial Sequence: Synthetic oligonucleotide
  Description of Combined DNA/RNA Molecule: Synthetic oligonucleotide
gcagcggugaccagcacgatt

SEQ ID NO: 507 - DNA, 21 bp, Artificial Sequence
  Description of Artificial Sequence: Synthetic oligonucleotide
  Description of Combined DNA/RNA Molecule: Synthetic oligonucleotide
uggucaccgcugccggcaatt

SEQ ID NO: 508 - DNA, 21 bp, Artificial Sequence
  Description of Artificial Sequence: Synthetic oligonucleotide
  Description of Combined DNA/RNA Molecule: Synthetic oligonucleotide
uugccggcagcggugaccatt

SEQ ID NO: 509 - DNA, 21 bp, Artificial Sequence
  Description of Artificial Sequence: Synthetic oligonucleotide
  Description of Combined DNA/RNA Molecule: Synthetic oligonucleotide
uggucaccgcugccggcaatt

SEQ ID NO: 510 - DNA, 21 bp, Artificial Sequence
  Description of Artificial Sequence: Synthetic oligonucleotide
  Description of Combined DNA/RNA Molecule: Synthetic oligonucleotide
uugccggcagcggugaccatt

SEQ ID NO: 511 - DNA, 21 bp, Artificial Sequence
  Description of Artificial Sequence: Synthetic oligonucleotide
  Description of Combined DNA/RNA Molecule: Synthetic oligonucleotide
ggucaccgcugccggcaactt

SEQ ID NO: 512 - DNA, 21 bp, Artificial Sequence
  Description of Artificial Sequence: Synthetic oligonucleotide
  Description of Combined DNA/RNA Molecule: Synthetic oligonucleotide
guugccggcagcggugacctt

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
ggucaccgcugccggcaactt

SEQ ID NO: 514 - DNA, 21 bp, Artificial Sequence
  Description of Artificial Sequence: Synthetic oligonucleotide
  Description of Combined DNA/RNA Molecule: Synthetic oligonucleotide
guugccggcagcggugacctt

SEQ ID NO: 515 - DNA, 21 bp, Artificial Sequence
  Description of Artificial Sequence: Synthetic oligonucleotide
  Description of Combined DNA/RNA Molecule: Synthetic oligonucleotide
caccgcugccggcaacuuctt

SEQ ID NO: 516 - DNA, 21 bp, Artificial Sequence
  Description of Artificial Sequence: Synthetic oligonucleotide
  Description of Combined DNA/RNA Molecule: Synthetic oligonucleotide
gaaguugccggcagcggugtt

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
caccgcugccggcaacuuctt

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
gaaguugccggcagcggugtt

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
ccgcugccggcaacuuccgtt

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
cggaaguugccggcagcggtt

SEQ ID NO: 521 - DNA, 21 bp, Artificial Sequence
  Description of Artificial Sequence: Synthetic oligonucleotide
  Description of Combined DNA/RNA Molecule: Synthetic oligonucleotide
ccgcugccggcaacuuccgtt

SEQ ID NO: 522 - DNA, 21 bp, Artificial Sequence
  Description of Artificial Sequence: Synthetic oligonucleotide
  Description of Combined DNA/RNA Molecule: Synthetic oligonucleotide
cggaaguugccggcagcggtt

SEQ ID NO: 523 - DNA, 21 bp, Artificial Sequence
  Description of Artificial Sequence: Synthetic oligonucleotide
  Description of Combined DNA/RNA Molecule: Synthetic oligonucleotide
cgcugccggcaacuuccggtt

SEQ ID NO: 524 - DNA, 21 bp, Artificial Sequence
  Description of Artificial Sequence: Synthetic oligonucleotide
  Description of Combined DNA/RNA Molecule: Synthetic oligonucleotide
ccggaaguugccggcagcgtt

SEQ ID NO: 525 - DNA, 21 bp, Artificial Sequence
  Description of Artificial Sequence: Synthetic oligonucleotide
  Description of Combined DNA/RNA Molecule: Synthetic oligonucleotide
cgcugccggcaacuuccggtt

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
ccggaaguugccggcagcgtt

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
gcugccggcaacuuccgggtt

SEQ ID NO: 528 - DNA, 21 bp, Artificial Sequence
  Description of Artificial Sequence: Synthetic oligonucleotide
  Description of Combined DNA/RNA Molecule: Synthetic oligonucleotide
cccggaaguugccggcagctt

SEQ ID NO: 529 - DNA, 21 bp, Artificial Sequence
  Description of Artificial Sequence: Synthetic oligonucleotide
  Description of Combined DNA/RNA Molecule: Synthetic oligonucleotide
gcugccggcaacuuccgggtt

SEQ ID NO: 530 - DNA, 21 bp, Artificial Sequence
  Description of Artificial Sequence: Synthetic oligonucleotide
  Description of Combined DNA/RNA Molecule: Synthetic oligonucleotide
cccggaaguugccggcagctt

SEQ ID NO: 531 - DNA, 21 bp, Artificial Sequence
  Description of Artificial Sequence: Synthetic oligonucleotide
  Description of Combined DNA/RNA Molecule: Synthetic oligonucleotide
cggcaacuuccgggacgautt

SEQ ID NO: 532 - DNA, 21 bp, Artificial Sequence
  Description of Artificial Sequence: Synthetic oligonucleotide
  Description of Combined DNA/RNA Molecule: Synthetic oligonucleotide
aucgucccggaaguugccgtt

SEQ ID NO: 533 - DNA, 21 bp, Artificial Sequence
  Description of Artificial Sequence: Synthetic oligonucleotide
  Description of Combined DNA/RNA Molecule: Synthetic oligonucleotide
cggcaacuuccgggacgautt

SEQ ID NO: 534 - DNA, 21 bp, Artificial Sequence
  Description of Artificial Sequence: Synthetic oligonucleotide
  Description of Combined DNA/RNA Molecule: Synthetic oligonucleotide
aucgucccggaaguugccgtt

SEQ ID NO: 535 - DNA, 21 bp, Artificial Sequence
  Description of Artificial Sequence: Synthetic oligonucleotide
  Description of Combined DNA/RNA Molecule: Synthetic oligonucleotide
ggcaacuuccgggacgaugtt

SEQ ID NO: 536 - DNA, 21 bp, Artificial Sequence
  Description of Artificial Sequence: Synthetic oligonucleotide
  Description of Combined DNA/RNA Molecule: Synthetic oligonucleotide
caucgucccggaaguugcctt

SEQ ID NO: 537 - DNA, 21 bp, Artificial Sequence
  Description of Artificial Sequence: Synthetic oligonucleotide
  Description of Combined DNA/RNA Molecule: Synthetic oligonucleotide
ggcaacuuccgggacgaugtt

SEQ ID NO: 538 - DNA, 21 bp, Artificial Sequence
  Description of Artificial Sequence: Synthetic oligonucleotide
  Description of Combined DNA/RNA Molecule: Synthetic oligonucleotide
caucgucccggaaguugcctt

SEQ ID NO: 539 - DNA, 21 bp, Artificial Sequence
  Description of Artificial Sequence: Synthetic oligonucleotide
  Description of Combined DNA/RNA Molecule: Synthetic oligonucleotide
uuccgggacgaugccugcctt

SEQ ID NO: 540 - DNA, 21 bp, Artificial Sequence
  Description of Artificial Sequence: Synthetic oligonucleotide
  Description of Combined DNA/RNA Molecule: Synthetic oligonucleotide
ggcaggcaucgucccggaatt

SEQ ID NO: 541 - DNA, 21 bp, Artificial Sequence
  Description of Artificial Sequence: Synthetic oligonucleotide
  Description of Combined DNA/RNA Molecule: Synthetic oligonucleotide
uuccgggacgaugccugcctt

SEQ ID NO: 542 - DNA, 21 bp, Artificial Sequence
  Description of Artificial Sequence: Synthetic oligonucleotide
  Description of Combined DNA/RNA Molecule: Synthetic oligonucleotide
ggcaggcaucgucccggaatt

SEQ ID NO: 543 - DNA, 21 bp, Artificial Sequence
  Description of Artificial Sequence: Synthetic oligonucleotide
  Description of Combined DNA/RNA Molecule: Synthetic oligonucleotide
ggacgaugccugccucuactt

SEQ ID NO: 544 - DNA, 21 bp, Artificial Sequence
  Description of Artificial Sequence: Synthetic oligonucleotide
  Description of Combined DNA/RNA Molecule: Synthetic oligonucleotide
guagaggcaggcaucgucctt

SEQ ID NO: 545 - DNA, 21 bp, Artificial Sequence
  Description of Artificial Sequence: Synthetic oligonucleotide
  Description of Combined DNA/RNA Molecule: Synthetic oligonucleotide
ggacgaugccugccucuactt

SEQ ID NO: 546 - DNA, 21 bp, Artificial Sequence
  Description of Artificial Sequence: Synthetic oligonucleotide
  Description of Combined DNA/RNA Molecule: Synthetic oligonucleotide
guagaggcaggcaucgucctt

SEQ ID NO: 547 - DNA, 21 bp, Artificial Sequence
  Description of Artificial Sequence: Synthetic oligonucleotide
  Description of Combined DNA/RNA Molecule: Synthetic oligonucleotide
ggacgaugccugccucuactt

SEQ ID NO: 548 - DNA, 21 bp, Artificial Sequence
  Description of Artificial Sequence: Synthetic oligonucleotide
  Description of Combined DNA/RNA Molecule: Synthetic oligonucleotide
guagaggcaggcaucgucctt

SEQ ID NO: 549 - DNA, 21 bp, Artificial Sequence
  Description of Artificial Sequence: Synthetic oligonucleotide
  Description of Combined DNA/RNA Molecule: Synthetic oligonucleotide
gcucccgaggucaucacagtt

SEQ ID NO: 550 - DNA, 21 bp, Artificial Sequence
  Description of Artificial Sequence: Synthetic oligonucleotide
  Description of Combined DNA/RNA Molecule: Synthetic oligonucleotide
cugugaugaccucgggagctt

SEQ ID NO: 551 - DNA, 21 bp, Artificial Sequence
  Description of Artificial Sequence: Synthetic oligonucleotide
  Description of Combined DNA/RNA Molecule: Synthetic oligonucleotide
cucccgaggucaucacagutt

SEQ ID NO: 552 - DNA, 21 bp, Artificial Sequence
  Description of Artificial Sequence: Synthetic oligonucleotide
  Description of Combined DNA/RNA Molecule: Synthetic oligonucleotide
acugugaugaccucgggagtt

SEQ ID NO: 553 - DNA, 21 bp, Artificial Sequence
  Description of Artificial Sequence: Synthetic oligonucleotide
  Description of Combined DNA/RNA Molecule: Synthetic oligonucleotide
ucccgaggucaucacaguutt

SEQ ID NO: 554 - DNA, 21 bp, Artificial Sequence
  Description of Artificial Sequence: Synthetic oligonucleotide
  Description of Combined DNA/RNA Molecule: Synthetic oligonucleotide
aacugugaugaccucgggatt

SEQ ID NO: 555 - DNA, 21 bp, Artificial Sequence
  Description of Artificial Sequence: Synthetic oligonucleotide
  Description of Combined DNA/RNA Molecule: Synthetic oligonucleotide
ccaagaccagccggugacctt

SEQ ID NO: 556 - DNA, 21 bp, Artificial Sequence
  Description of Artificial Sequence: Synthetic oligonucleotide
  Description of Combined DNA/RNA Molecule: Synthetic oligonucleotide
ggucaccggcuggucuuggtt

SEQ ID NO: 557 - DNA, 21 bp, Artificial Sequence
  Description of Artificial Sequence: Synthetic oligonucleotide
  Description of Combined DNA/RNA Molecule: Synthetic oligonucleotide
caagaccagccggugaccctt

SEQ ID NO: 558 - DNA, 21 bp, Artificial Sequence
  Description of Artificial Sequence: Synthetic oligonucleotide
  Description of Combined DNA/RNA Molecule: Synthetic oligonucleotide
gggucaccggcuggucuugtt

SEQ ID NO: 559 - DNA, 21 bp, Artificial Sequence
  Description of Artificial Sequence: Synthetic oligonucleotide
  Description of Combined DNA/RNA Molecule: Synthetic oligonucleotide
accaacuuuggccgcugugtt

SEQ ID NO: 560 - DNA, 21 bp, Artificial Sequence
  Description of Artificial Sequence: Synthetic oligonucleotide
  Description of Combined DNA/RNA Molecule: Synthetic oligonucleotide
cacagcggccaaaguuggutt

SEQ ID NO: 561 - DNA, 21 bp, Artificial Sequence
  Description of Artificial Sequence: Synthetic oligonucleotide
  Description of Combined DNA/RNA Molecule: Synthetic oligonucleotide
accaacuuuggccgcugugtt

SEQ ID NO: 562 - DNA, 21 bp, Artificial Sequence
  Description of Artificial Sequence: Synthetic oligonucleotide
  Description of Combined DNA/RNA Molecule: Synthetic oligonucleotide
cacagcggccaaaguuggutt

SEQ ID NO: 563 - DNA, 21 bp, Artificial Sequence
  Description of Artificial Sequence: Synthetic oligonucleotide
  Description of Combined DNA/RNA Molecule: Synthetic oligonucleotide
caacuuuggccgcugugugtt

SEQ ID NO: 564 - DNA, 21 bp, Artificial Sequence
  Description of Artificial Sequence: Synthetic oligonucleotide
  Description of Combined DNA/RNA Molecule: Synthetic oligonucleotide
cacacagcggccaaaguugtt

SEQ ID NO: 565 - DNA, 21 bp, Artificial Sequence
  Description of Artificial Sequence: Synthetic oligonucleotide
  Description of Combined DNA/RNA Molecule: Synthetic oligonucleotide
caacuuuggccgcugugugtt

SEQ ID NO: 566 - DNA, 21 bp, Artificial Sequence
  Description of Artificial Sequence: Synthetic oligonucleotide
  Description of Combined DNA/RNA Molecule: Synthetic oligonucleotide
cacacagcggccaaaguugtt

SEQ ID NO: 567 - DNA, 21 bp, Artificial Sequence
  Description of Artificial Sequence: Synthetic oligonucleotide
  Description of Combined DNA/RNA Molecule: Synthetic oligonucleotide
cgcuguguggaccucuuugtt

SEQ ID NO: 568 - DNA, 21 bp, Artificial Sequence
  Description of Artificial Sequence: Synthetic oligonucleotide
  Description of Combined DNA/RNA Molecule: Synthetic oligonucleotide
caaagagguccacacagcgtt

SEQ ID NO: 569 - DNA, 21 bp, Artificial Sequence
  Description of Artificial Sequence: Synthetic oligonucleotide
  Description of Combined DNA/RNA Molecule: Synthetic oligonucleotide
cgcuguguggaccucuuugtt

SEQ ID NO: 570 - DNA, 21 bp, Artificial Sequence
  Description of Artificial Sequence: Synthetic oligonucleotide
  Description of Combined DNA/RNA Molecule: Synthetic oligonucleotide
caaagagguccacacagcgtt

SEQ ID NO: 571 - DNA, 21 bp, Artificial Sequence
  Description of Artificial Sequence: Synthetic oligonucleotide
  Description of Combined DNA/RNA Molecule: Synthetic oligonucleotide
gacaucauuggugccuccatt

SEQ ID NO: 572 - DNA, 21 bp, Artificial Sequence
  Description of Artificial Sequence: Synthetic oligonucleotide
  Description of Combined DNA/RNA Molecule: Synthetic oligonucleotide
uggaggcaccaaugauguctt

SEQ ID NO: 573 - DNA, 21 bp, Artificial Sequence
  Description of Artificial Sequence: Synthetic oligonucleotide
  Description of Combined DNA/RNA Molecule: Synthetic oligonucleotide
gacaucauuggugccuccatt

SEQ ID NO: 574 - DNA, 21 bp, Artificial Sequence
  Description of Artificial Sequence: Synthetic oligonucleotide
  Description of Combined DNA/RNA Molecule: Synthetic oligonucleotide
uggaggcaccaaugauguctt

SEQ ID NO: 575 - DNA, 21 bp, Artificial Sequence
  Description of Artificial Sequence: Synthetic oligonucleotide
  Description of Combined DNA/RNA Molecule: Synthetic oligonucleotide
ucauuggugccuccagcgatt

SEQ ID NO: 576 - DNA, 21 bp, Artificial Sequence
  Description of Artificial Sequence: Synthetic oligonucleotide
  Description of Combined DNA/RNA Molecule: Synthetic oligonucleotide
ucgcuggaggcaccaaugatt

SEQ ID NO: 577 - DNA, 21 bp, Artificial Sequence
  Description of Artificial Sequence: Synthetic oligonucleotide
  Description of Combined DNA/RNA Molecule: Synthetic oligonucleotide
ucauuggugccuccagcgatt

SEQ ID NO: 578 - DNA, 21 bp, Artificial Sequence
  Description of Artificial Sequence: Synthetic oligonucleotide
  Description of Combined DNA/RNA Molecule: Synthetic oligonucleotide
ucgcuggaggcaccaaugatt

SEQ ID NO: 579 - DNA, 21 bp, Artificial Sequence
  Description of Artificial Sequence: Synthetic oligonucleotide
  Description of Combined DNA/RNA Molecule: Synthetic oligonucleotide
agcaccugcuuugugucactt

SEQ ID NO: 580 - DNA, 21 bp, Artificial Sequence
  Description of Artificial Sequence: Synthetic oligonucleotide
  Description of Combined DNA/RNA Molecule: Synthetic oligonucleotide
gugacacaaagcaggugcutt

SEQ ID NO: 581 - DNA, 21 bp, Artificial Sequence
  Description of Artificial Sequence: Synthetic oligonucleotide
  Description of Combined DNA/RNA Molecule: Synthetic oligonucleotide
agcaccugcuuugugucactt

SEQ ID NO: 582 - DNA, 21 bp, Artificial Sequence
  Description of Artificial Sequence: Synthetic oligonucleotide
  Description of Combined DNA/RNA Molecule: Synthetic oligonucleotide
gugacacaaagcaggugcutt

SEQ ID NO: 583 - DNA, 21 bp, Artificial Sequence
  Description of Artificial Sequence: Synthetic oligonucleotide
  Description of Combined DNA/RNA Molecule: Synthetic oligonucleotide
cacagagugggacaucacatt

SEQ ID NO: 584 - DNA, 21 bp, Artificial Sequence
  Description of Artificial Sequence: Synthetic oligonucleotide
  Description of Combined DNA/RNA Molecule: Synthetic oligonucleotide
ugugaugucccacucugugtt

SEQ ID NO: 585 - DNA, 21 bp, Artificial Sequence
  Description of Artificial Sequence: Synthetic oligonucleotide
  Description of Combined DNA/RNA Molecule: Synthetic oligonucleotide
augcugucugccgagccggtt

SEQ ID NO: 586 - DNA, 21 bp, Artificial Sequence
  Description of Artificial Sequence: Synthetic oligonucleotide
  Description of Combined DNA/RNA Molecule: Synthetic oligonucleotide
ccggcucggcagacagcautt

SEQ ID NO: 587 - DNA, 21 bp, Artificial Sequence
  Description of Artificial Sequence: Synthetic oligonucleotide
  Description of Combined DNA/RNA Molecule: Synthetic oligonucleotide
augcugucugccgagccggtt

SEQ ID NO: 588 - DNA, 21 bp, Artificial Sequence
  Description of Artificial Sequence: Synthetic oligonucleotide
  Description of Combined DNA/RNA Molecule: Synthetic oligonucleotide
ccggcucggcagacagcautt

SEQ ID NO: 589 - DNA, 21 bp, Artificial Sequence
  Description of Artificial Sequence: Synthetic oligonucleotide
  Description of Combined DNA/RNA Molecule: Synthetic oligonucleotide
gucugccgagccggagcuctt

SEQ ID NO: 590 - DNA, 21 bp, Artificial Sequence
  Description of Artificial Sequence: Synthetic oligonucleotide
  Description of Combined DNA/RNA Molecule: Synthetic oligonucleotide
gagcuccggcucggcagactt

SEQ ID NO: 591 - DNA, 21 bp, Artificial Sequence
  Description of Artificial Sequence: Synthetic oligonucleotide
  Description of Combined DNA/RNA Molecule: Synthetic oligonucleotide
gucugccgagccggagcuctt

SEQ ID NO: 592 - DNA, 21 bp, Artificial Sequence
  Description of Artificial Sequence: Synthetic oligonucleotide
  Description of Combined DNA/RNA Molecule: Synthetic oligonucleotide
gagcuccggcucggcagactt

SEQ ID NO: 593 - DNA, 21 bp, Artificial Sequence
  Description of Artificial Sequence: Synthetic oligonucleotide
  Description of Combined DNA/RNA Molecule: Synthetic oligonucleotide
guugaggcagagacugauctt

SEQ ID NO: 594 - DNA, 21 bp, Artificial Sequence
  Description of Artificial Sequence: Synthetic oligonucleotide
  Description of Combined DNA/RNA Molecule: Synthetic oligonucleotide
gaucagucucugccucaactt

SEQ ID NO: 595 - DNA, 21 bp, Artificial Sequence
  Description of Artificial Sequence: Synthetic oligonucleotide
  Description of Combined DNA/RNA Molecule: Synthetic oligonucleotide
guugaggcagagacugauctt

SEQ ID NO: 596 - DNA, 21 bp, Artificial Sequence
  Description of Artificial Sequence: Synthetic oligonucleotide
  Description of Combined DNA/RNA Molecule: Synthetic oligonucleotide
gaucagucucugccucaactt

SEQ ID NO: 597 - DNA, 21 bp, Artificial Sequence
  Description of Artificial Sequence: Synthetic oligonucleotide
  Description of Combined DNA/RNA Molecule: Synthetic oligonucleotide
gcagagacugauccacuuctt

SEQ ID NO: 598 - DNA, 21 bp, Artificial Sequence
  Description of Artificial Sequence: Synthetic oligonucleotide
  Description of Combined DNA/RNA Molecule: Synthetic oligonucleotide
gaaguggaucagucucugctt

SEQ ID NO: 599 - DNA, 21 bp, Artificial Sequence
  Description of Artificial Sequence: Synthetic oligonucleotide
  Description of Combined DNA/RNA Molecule: Synthetic oligonucleotide
gcagagacugauccacuuctt

SEQ ID NO: 600 - DNA, 21 bp, Artificial Sequence
  Description of Artificial Sequence: Synthetic oligonucleotide
  Description of Combined DNA/RNA Molecule: Synthetic oligonucleotide
gaaguggaucagucucugctt

SEQ ID NO: 601 - DNA, 21 bp, Artificial Sequence
  Description of Artificial Sequence: Synthetic oligonucleotide
  Description of Combined DNA/RNA Molecule: Synthetic oligonucleotide
agagacugauccacuucuctt

SEQ ID NO: 602 - DNA, 21 bp, Artificial Sequence
  Description of Artificial Sequence: Synthetic oligonucleotide
  Description of Combined DNA/RNA Molecule: Synthetic oligonucleotide
gagaaguggaucagucucutt

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
agagacugauccacuucuctt

SEQ ID NO: 604 - DNA, 21 bp, Artificial Sequence
  Description of Artificial Sequence: Synthetic oligonucleotide
  Description of Combined DNA/RNA Molecule: Synthetic oligonucleotide
gagaaguggaucagucucutt

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
uucucugccaaagaugucatt

SEQ ID NO: 606 - DNA, 21 bp, Artificial Sequence
  Description of Artificial Sequence: Synthetic oligonucleotide
  Description of Combined DNA/RNA Molecule: Synthetic oligonucleotide
ugacaucuuuggcagagaatt

SEQ ID NO: 607 - DNA, 21 bp, Artificial Sequence
  Description of Artificial Sequence: Synthetic oligonucleotide
  Description of Combined DNA/RNA Molecule: Synthetic oligonucleotide
uucucugccaaagaugucatt

SEQ ID NO: 608 - DNA, 21 bp, Artificial Sequence
  Description of Artificial Sequence: Synthetic oligonucleotide
  Description of Combined DNA/RNA Molecule: Synthetic oligonucleotide
ugacaucuuuggcagagaatt

SEQ ID NO: 609 - DNA, 21 bp, Artificial Sequence
  Description of Artificial Sequence: Synthetic oligonucleotide
  Description of Combined DNA/RNA Molecule: Synthetic oligonucleotide
cucugccaaagaugucauctt

SEQ ID NO: 610 - DNA, 21 bp, Artificial Sequence
  Description of Artificial Sequence: Synthetic oligonucleotide
  Description of Combined DNA/RNA Molecule: Synthetic oligonucleotide
gaugacaucuuuggcagagtt

SEQ ID NO: 611 - DNA, 21 bp, Artificial Sequence
  Description of Artificial Sequence: Synthetic oligonucleotide
  Description of Combined DNA/RNA Molecule: Synthetic oligonucleotide
cucugccaaagaugucauctt

SEQ ID NO: 612 - DNA, 21 bp, Artificial Sequence
  Description of Artificial Sequence: Synthetic oligonucleotide
  Description of Combined DNA/RNA Molecule: Synthetic oligonucleotide
gaugacaucuuuggcagagtt

SEQ ID NO: 613 - DNA, 21 bp, Artificial Sequence
  Description of Artificial Sequence: Synthetic oligonucleotide
  Description of Combined DNA/RNA Molecule: Synthetic oligonucleotide
cugaggaccagcggguacutt

SEQ ID NO: 614 - DNA, 21 bp, Artificial Sequence
  Description of Artificial Sequence: Synthetic oligonucleotide
  Description of Combined DNA/RNA Molecule: Synthetic oligonucleotide
aguacccgcugguccucagtt

SEQ ID NO: 615 - DNA, 21 bp, Artificial Sequence
  Description of Artificial Sequence: Synthetic oligonucleotide
  Description of Combined DNA/RNA Molecule: Synthetic oligonucleotide
cugaggaccagcggguacutt

SEQ ID NO: 616 - DNA, 21 bp, Artificial Sequence
  Description of Artificial Sequence: Synthetic oligonucleotide
  Description of Combined DNA/RNA Molecule: Synthetic oligonucleotide
aguacccgcugguccucagtt

SEQ ID NO: 617 - DNA, 21 bp, Artificial Sequence
  Description of Artificial Sequence: Synthetic oligonucleotide
  Description of Combined DNA/RNA Molecule: Synthetic oligonucleotide
ugaggaccagcggguacugtt

SEQ ID NO: 618 - DNA, 21 bp, Artificial Sequence
  Description of Artificial Sequence: Synthetic oligonucleotide
  Description of Combined DNA/RNA Molecule: Synthetic oligonucleotide
caguacccgcugguccucatt

SEQ ID NO: 619 - DNA, 21 bp, Artificial Sequence
  Description of Artificial Sequence: Synthetic oligonucleotide
  Description of Combined DNA/RNA Molecule: Synthetic oligonucleotide
ugaggaccagcggguacugtt

SEQ ID NO: 620 - DNA, 21 bp, Artificial Sequence
  Description of Artificial Sequence: Synthetic oligonucleotide
  Description of Combined DNA/RNA Molecule: Synthetic oligonucleotide
caguacccgcugguccucatt

SEQ ID NO: 621 - DNA, 21 bp, Artificial Sequence
  Description of Artificial Sequence: Synthetic oligonucleotide
  Description of Combined DNA/RNA Molecule: Synthetic oligonucleotide
acuguauggucagcacacutt

SEQ ID NO: 622 - DNA, 21 bp, Artificial Sequence
  Description of Artificial Sequence: Synthetic oligonucleotide
  Description of Combined DNA/RNA Molecule: Synthetic oligonucleotide
agugugcugaccauacagutt

SEQ ID NO: 623 - DNA, 21 bp, Artificial Sequence
  Description of Artificial Sequence: Synthetic oligonucleotide
  Description of Combined DNA/RNA Molecule: Synthetic oligonucleotide
uguauggucagcacacucgtt

SEQ ID NO: 624 - DNA, 21 bp, Artificial Sequence
  Description of Artificial Sequence: Synthetic oligonucleotide
  Description of Combined DNA/RNA Molecule: Synthetic oligonucleotide
cgagugugcugaccauacatt

SEQ ID NO: 625 - DNA, 21 bp, Artificial Sequence
  Description of Artificial Sequence: Synthetic oligonucleotide
  Description of Combined DNA/RNA Molecule: Synthetic oligonucleotide
guauggucagcacacucggtt

SEQ ID NO: 626 - DNA, 21 bp, Artificial Sequence
  Description of Artificial Sequence: Synthetic oligonucleotide
  Description of Combined DNA/RNA Molecule: Synthetic oligonucleotide
ccgagugugcugaccauactt

SEQ ID NO: 627 - DNA, 21 bp, Artificial Sequence
  Description of Artificial Sequence: Synthetic oligonucleotide
  Description of Combined DNA/RNA Molecule: Synthetic oligonucleotide
ggauggccacagccgucgctt

SEQ ID NO: 628 - DNA, 21 bp, Artificial Sequence
  Description of Artificial Sequence: Synthetic oligonucleotide
  Description of Combined DNA/RNA Molecule: Synthetic oligonucleotide
gcgacggcuguggccaucctt

SEQ ID NO: 629 - DNA, 21 bp, Artificial Sequence
  Description of Artificial Sequence: Synthetic oligonucleotide
  Description of Combined DNA/RNA Molecule: Synthetic oligonucleotide
gauggccacagccgucgcctt

SEQ ID NO: 630 - DNA, 21 bp, Artificial Sequence
  Description of Artificial Sequence: Synthetic oligonucleotide
  Description of Combined DNA/RNA Molecule: Synthetic oligonucleotide
ggcgacggcuguggccauctt

SEQ ID NO: 631 - DNA, 21 bp, Artificial Sequence
  Description of Artificial Sequence: Synthetic oligonucleotide
  Description of Combined DNA/RNA Molecule: Synthetic oligonucleotide
caagcuggucugccgggcctt

SEQ ID NO: 632 - DNA, 21 bp, Artificial Sequence
  Description of Artificial Sequence: Synthetic oligonucleotide
  Description of Combined DNA/RNA Molecule: Synthetic oligonucleotide
ggcccggcagaccagcuugtt

SEQ ID NO: 633 - DNA, 21 bp, Artificial Sequence
  Description of Artificial Sequence: Synthetic oligonucleotide
  Description of Combined DNA/RNA Molecule: Synthetic oligonucleotide
cugccgggcccacaacgcutt

SEQ ID NO: 634 - DNA, 21 bp, Artificial Sequence
  Description of Artificial Sequence: Synthetic oligonucleotide
  Description of Combined DNA/RNA Molecule: Synthetic oligonucleotide
agcguugugggcccggcagtt

SEQ ID NO: 635 - DNA, 21 bp, Artificial Sequence
  Description of Artificial Sequence: Synthetic oligonucleotide
  Description of Combined DNA/RNA Molecule: Synthetic oligonucleotide
cugccgggcccacaacgcutt

SEQ ID NO: 636 - DNA, 21 bp, Artificial Sequence
  Description of Artificial Sequence: Synthetic oligonucleotide
  Description of Combined DNA/RNA Molecule: Synthetic oligonucleotide
agcguugugggcccggcagtt

SEQ ID NO: 637 - DNA, 21 bp, Artificial Sequence
  Description of Artificial Sequence: Synthetic oligonucleotide
  Description of Combined DNA/RNA Molecule: Synthetic oligonucleotide
ugccgggcccacaacgcuutt

SEQ ID NO: 638 - DNA, 21 bp, Artificial Sequence
  Description of Artificial Sequence: Synthetic oligonucleotide
  Description of Combined DNA/RNA Molecule: Synthetic oligonucleotide
aagcguugugggcccggcatt

SEQ ID NO: 639 - DNA, 21 bp, Artificial Sequence
  Description of Artificial Sequence: Synthetic oligonucleotide
  Description of Combined DNA/RNA Molecule: Synthetic oligonucleotide
ugccgggcccacaacgcuutt

SEQ ID NO: 640 - DNA, 21 bp, Artificial Sequence
  Description of Artificial Sequence: Synthetic oligonucleotide
  Description of Combined DNA/RNA Molecule: Synthetic oligonucleotide
aagcguugugggcccggcatt

SEQ ID NO: 641 - DNA, 21 bp, Artificial Sequence
  Description of Artificial Sequence: Synthetic oligonucleotide
  Description of Combined DNA/RNA Molecule: Synthetic oligonucleotide
ccgggcccacaacgcuuuutt

SEQ ID NO: 642 - DNA, 21 bp, Artificial Sequence
  Description of Artificial Sequence: Synthetic oligonucleotide
  Description of Combined DNA/RNA Molecule: Synthetic oligonucleotide
aaaagcguugugggcccggtt

SEQ ID NO: 643 - DNA, 21 bp, Artificial Sequence
  Description of Artificial Sequence: Synthetic oligonucleotide
  Description of Combined DNA/RNA Molecule: Synthetic oligonucleotide
ccgggcccacaacgcuuuutt

SEQ ID NO: 644 - DNA, 21 bp, Artificial Sequence
  Description of Artificial Sequence: Synthetic oligonucleotide
  Description of Combined DNA/RNA Molecule: Synthetic oligonucleotide
aaaagcguugugggcccggtt

SEQ ID NO: 645 - DNA, 21 bp, Artificial Sequence
  Description of Artificial Sequence: Synthetic oligonucleotide
  Description of Combined DNA/RNA Molecule: Synthetic oligonucleotide
gggcccacaacgcuuuuggtt

SEQ ID NO: 646 - DNA, 21 bp, Artificial Sequence
  Description of Artificial Sequence: Synthetic oligonucleotide
  Description of Combined DNA/RNA Molecule: Synthetic oligonucleotide
ccaaaagcguugugggccctt

SEQ ID NO: 647 - DNA, 21 bp, Artificial Sequence
  Description of Artificial Sequence: Synthetic oligonucleotide
  Description of Combined DNA/RNA Molecule: Synthetic oligonucleotide
gggcccacaacgcuuuuggtt

SEQ ID NO: 648 - DNA, 21 bp, Artificial Sequence
  Description of Artificial Sequence: Synthetic oligonucleotide
  Description of Combined DNA/RNA Molecule: Synthetic oligonucleotide
ccaaaagcguugugggccctt

SEQ ID NO: 649 - DNA, 21 bp, Artificial Sequence
  Description of Artificial Sequence: Synthetic oligonucleotide
  Description of Combined DNA/RNA Molecule: Synthetic oligonucleotide
ggugagggugucuacgccatt

SEQ ID NO: 650 - DNA, 21 bp, Artificial Sequence
  Description of Artificial Sequence: Synthetic oligonucleotide
  Description of Combined DNA/RNA Molecule: Synthetic oligonucleotide
uggcguagacacccucacctt

SEQ ID NO: 651 - DNA, 21 bp, Artificial Sequence
  Description of Artificial Sequence: Synthetic oligonucleotide
  Description of Combined DNA/RNA Molecule: Synthetic oligonucleotide
ggugagggugucuacgccatt

SEQ ID NO: 652 - DNA, 21 bp, Artificial Sequence
  Description of Artificial Sequence: Synthetic oligonucleotide
  Description of Combined DNA/RNA Molecule: Synthetic oligonucleotide
uggcguagacacccucacctt

SEQ ID NO: 653 - DNA, 21 bp, Artificial Sequence
  Description of Artificial Sequence: Synthetic oligonucleotide
  Description of Combined DNA/RNA Molecule: Synthetic oligonucleotide
gagggugucuacgccauugtt

SEQ ID NO: 654 - DNA, 21 bp, Artificial Sequence
  Description of Artificial Sequence: Synthetic oligonucleotide
  Description of Combined DNA/RNA Molecule: Synthetic oligonucleotide
caauggcguagacacccuctt

SEQ ID NO: 655 - DNA, 21 bp, Artificial Sequence
  Description of Artificial Sequence: Synthetic oligonucleotide
  Description of Combined DNA/RNA Molecule: Synthetic oligonucleotide
gagggugucuacgccauugtt

SEQ ID NO: 656 - DNA, 21 bp, Artificial Sequence
  Description of Artificial Sequence: Synthetic oligonucleotide
  Description of Combined DNA/RNA Molecule: Synthetic oligonucleotide
caauggcguagacacccuctt

SEQ ID NO: 657 - DNA, 21 bp, Artificial Sequence
  Description of Artificial Sequence: Synthetic oligonucleotide
  Description of Combined DNA/RNA Molecule: Synthetic oligonucleotide
gccaggugcugccugcuactt

SEQ ID NO: 658 - DNA, 21 bp, Artificial Sequence
  Description of Artificial Sequence: Synthetic oligonucleotide
  Description of Combined DNA/RNA Molecule: Synthetic oligonucleotide
guagcaggcagcaccuggctt

SEQ ID NO: 659 - DNA, 21 bp, Artificial Sequence
  Description of Artificial Sequence: Synthetic oligonucleotide
  Description of Combined DNA/RNA Molecule: Synthetic oligonucleotide
gccaggugcugccugcuactt

SEQ ID NO: 660 - DNA, 21 bp, Artificial Sequence
  Description of Artificial Sequence: Synthetic oligonucleotide
  Description of Combined DNA/RNA Molecule: Synthetic oligonucleotide
guagcaggcagcaccuggctt

SEQ ID NO: 661 - DNA, 21 bp, Artificial Sequence
  Description of Artificial Sequence: Synthetic oligonucleotide
  Description of Combined DNA/RNA Molecule: Synthetic oligonucleotide
ccaggugcugccugcuacctt

SEQ ID NO: 662 - DNA, 21 bp, Artificial Sequence
  Description of Artificial Sequence: Synthetic oligonucleotide
  Description of Combined DNA/RNA Molecule: Synthetic oligonucleotide
gguagcaggcagcaccuggtt

SEQ ID NO: 663 - DNA, 21 bp, Artificial Sequence
  Description of Artificial Sequence: Synthetic oligonucleotide
  Description of Combined DNA/RNA Molecule: Synthetic oligonucleotide
ccaggugcugccugcuacctt

SEQ ID NO: 664 - DNA, 21 bp, Artificial Sequence
  Description of Artificial Sequence: Synthetic oligonucleotide
  Description of Combined DNA/RNA Molecule: Synthetic oligonucleotide
gguagcaggcagcaccuggtt

SEQ ID NO: 665 - DNA, 21 bp, Artificial Sequence
  Description of Artificial Sequence: Synthetic oligonucleotide
  Description of Combined DNA/RNA Molecule: Synthetic oligonucleotide
acccacaagccgccugugctt

SEQ ID NO: 666 - DNA, 21 bp, Artificial Sequence
  Description of Artificial Sequence: Synthetic oligonucleotide
  Description of Combined DNA/RNA Molecule: Synthetic oligonucleotide
gcacaggcggcuugugggutt

SEQ ID NO: 667 - DNA, 21 bp, Artificial Sequence
  Description of Artificial Sequence: Synthetic oligonucleotide
  Description of Combined DNA/RNA Molecule: Synthetic oligonucleotide
gugcugaggccacgagguctt

SEQ ID NO: 668 - DNA, 21 bp, Artificial Sequence
  Description of Artificial Sequence: Synthetic oligonucleotide
  Description of Combined DNA/RNA Molecule: Synthetic oligonucleotide
gaccucguggccucagcactt

SEQ ID NO: 669 - DNA, 21 bp, Artificial Sequence
  Description of Artificial Sequence: Synthetic oligonucleotide
  Description of Combined DNA/RNA Molecule: Synthetic oligonucleotide
gugcugaggccacgagguctt

SEQ ID NO: 670 - DNA, 21 bp, Artificial Sequence
  Description of Artificial Sequence: Synthetic oligonucleotide
  Description of Combined DNA/RNA Molecule: Synthetic oligonucleotide
gaccucguggccucagcactt

SEQ ID NO: 671 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 672 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 673 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 674 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 675 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 676 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 677 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 678 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 679 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 680 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 681 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 682 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 683 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 684 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 685 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 686 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 687 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 688 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 689 - DNA, 21 bp, Artificial Sequence
  Description of Artificial Sequence: Synthetic oligonucleotide
  Description of Combined DNA/RNA Molecule: Synthetic oligonucleotide
ugcugaggccacgaggucatt

SEQ ID NO: 690 - DNA, 21 bp, Artificial Sequence
  Description of Artificial Sequence: Synthetic oligonucleotide
  Description of Combined DNA/RNA Molecule: Synthetic oligonucleotide
ugaccucguggccucagcatt

SEQ ID NO: 691 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 692 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 693 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 694 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 695 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 696 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 697 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 698 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 699 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 700 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 701 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 702 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 703 - DNA, 21 bp, Artificial Sequence
  Description of Artificial Sequence: Synthetic oligonucleotide
  Description of Combined DNA/RNA Molecule: Synthetic oligonucleotide
guggucagcggccgggaugtt

SEQ ID NO: 704 - DNA, 21 bp, Artificial Sequence
  Description of Artificial Sequence: Synthetic oligonucleotide
  Description of Combined DNA/RNA Molecule: Synthetic oligonucleotide
caucccggccgcugaccactt

SEQ ID NO: 705 - DNA, 21 bp, Artificial Sequence
  Description of Artificial Sequence: Synthetic oligonucleotide
  Description of Combined DNA/RNA Molecule: Synthetic oligonucleotide
ggccacgaggucagcccaatt

SEQ ID NO: 706 - DNA, 21 bp, Artificial Sequence
  Description of Artificial Sequence: Synthetic oligonucleotide
  Description of Combined DNA/RNA Molecule: Synthetic oligonucleotide
uugggcugaccucguggcctt

SEQ ID NO: 707 - DNA, 21 bp, Artificial Sequence
  Description of Artificial Sequence: Synthetic oligonucleotide
  Description of Combined DNA/RNA Molecule: Synthetic oligonucleotide
cgaggucagcccaaccagutt

SEQ ID NO: 708 - DNA, 21 bp, Artificial Sequence
  Description of Artificial Sequence: Synthetic oligonucleotide
  Description of Combined DNA/RNA Molecule: Synthetic oligonucleotide
acugguugggcugaccucgtt

SEQ ID NO: 709 - DNA, 21 bp, Artificial Sequence
  Description of Artificial Sequence: Synthetic oligonucleotide
  Description of Combined DNA/RNA Molecule: Synthetic oligonucleotide
gucagcccaaccagugcgutt

SEQ ID NO: 710 - DNA, 21 bp, Artificial Sequence
  Description of Artificial Sequence: Synthetic oligonucleotide
  Description of Combined DNA/RNA Molecule: Synthetic oligonucleotide
acgcacugguugggcugactt

SEQ ID NO: 711 - DNA, 21 bp, Artificial Sequence
  Description of Artificial Sequence: Synthetic oligonucleotide
  Description of Combined DNA/RNA Molecule: Synthetic oligonucleotide
cagcccaaccagugcguggtt

SEQ ID NO: 712 - DNA, 21 bp, Artificial Sequence
  Description of Artificial Sequence: Synthetic oligonucleotide
  Description of Combined DNA/RNA Molecule: Synthetic oligonucleotide
ccacgcacugguugggcugtt

SEQ ID NO: 713 - DNA, 21 bp, Artificial Sequence
  Description of Artificial Sequence: Synthetic oligonucleotide
  Description of Combined DNA/RNA Molecule: Synthetic oligonucleotide
cacagggaggccagcaucctt

SEQ ID NO: 714 - DNA, 21 bp, Artificial Sequence
  Description of Artificial Sequence: Synthetic oligonucleotide
  Description of Combined DNA/RNA Molecule: Synthetic oligonucleotide
ggaugcuggccucccugugtt

SEQ ID NO: 715 - DNA, 21 bp, Artificial Sequence
  Description of Artificial Sequence: Synthetic oligonucleotide
  Description of Combined DNA/RNA Molecule: Synthetic oligonucleotide
ccagcauccacgcuuccugtt

SEQ ID NO: 716 - DNA, 21 bp, Artificial Sequence
  Description of Artificial Sequence: Synthetic oligonucleotide
  Description of Combined DNA/RNA Molecule: Synthetic oligonucleotide
caggaagcguggaugcuggtt

SEQ ID NO: 717 - DNA, 21 bp, Artificial Sequence
  Description of Artificial Sequence: Synthetic oligonucleotide
  Description of Combined DNA/RNA Molecule: Synthetic oligonucleotide
ccagcauccacgcuuccugtt

SEQ ID NO: 718 - DNA, 21 bp, Artificial Sequence
  Description of Artificial Sequence: Synthetic oligonucleotide
  Description of Combined DNA/RNA Molecule: Synthetic oligonucleotide
caggaagcguggaugcuggtt

SEQ ID NO: 719 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 720 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 721 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 722 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 723 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 724 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 725 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 726 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 727 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 728 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 729 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 730 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 731 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 732 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 733 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 734 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 735 - DNA, 21 bp, Artificial Sequence
  Description of Artificial Sequence: Synthetic oligonucleotide
  Description of Combined DNA/RNA Molecule: Synthetic oligonucleotide
agucaaggagcauggaauctt

SEQ ID NO: 736 - DNA, 21 bp, Artificial Sequence
  Description of Artificial Sequence: Synthetic oligonucleotide
  Description of Combined DNA/RNA Molecule: Synthetic oligonucleotide
gauuccaugcuccuugacutt

SEQ ID NO: 737 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 738 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 739 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 740 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 741 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 742 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 743 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 744 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 745 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 746 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 747 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 748 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 749 - DNA, 21 bp, Artificial Sequence
  Description of Artificial Sequence: Synthetic oligonucleotide
  Description of Combined DNA/RNA Molecule: Synthetic oligonucleotide
gcggcacccucauaggccutt

SEQ ID NO: 750 - DNA, 21 bp, Artificial Sequence
  Description of Artificial Sequence: Synthetic oligonucleotide
  Description of Combined DNA/RNA Molecule: Synthetic oligonucleotide
aggccuaugagggugccgctt

SEQ ID NO: 751 - DNA, 21 bp, Artificial Sequence
  Description of Artificial Sequence: Synthetic oligonucleotide
  Description of Combined DNA/RNA Molecule: Synthetic oligonucleotide
aaggagcauggaaucccggtt

SEQ ID NO: 752 - DNA, 21 bp, Artificial Sequence
  Description of Artificial Sequence: Synthetic oligonucleotide
  Description of Combined DNA/RNA Molecule: Synthetic oligonucleotide
ccgggauuccaugcuccuutt

SEQ ID NO: 753 - DNA, 21 bp, Artificial Sequence
  Description of Artificial Sequence: Synthetic oligonucleotide
  Description of Combined DNA/RNA Molecule: Synthetic oligonucleotide
aaggagcauggaaucccggtt

SEQ ID NO: 754 - DNA, 21 bp, Artificial Sequence
  Description of Artificial Sequence: Synthetic oligonucleotide
  Description of Combined DNA/RNA Molecule: Synthetic oligonucleotide
ccgggauuccaugcuccuutt

SEQ ID NO: 755 - DNA, 21 bp, Artificial Sequence
  Description of Artificial Sequence: Synthetic oligonucleotide
  Description of Combined DNA/RNA Molecule: Synthetic oligonucleotide
aggagcauggaaucccggctt

SEQ ID NO: 756 - DNA, 21 bp, Artificial Sequence
  Description of Artificial Sequence: Synthetic oligonucleotide
  Description of Combined DNA/RNA Molecule: Synthetic oligonucleotide
gccgggauuccaugcuccutt

SEQ ID NO: 757 - DNA, 21 bp, Artificial Sequence
  Description of Artificial Sequence: Synthetic oligonucleotide
  Description of Combined DNA/RNA Molecule: Synthetic oligonucleotide
aggagcauggaaucccggctt

SEQ ID NO: 758 - DNA, 21 bp, Artificial Sequence
  Description of Artificial Sequence: Synthetic oligonucleotide
  Description of Combined DNA/RNA Molecule: Synthetic oligonucleotide
gccgggauuccaugcuccutt

SEQ ID NO: 759 - DNA, 21 bp, Artificial Sequence
  Description of Artificial Sequence: Synthetic oligonucleotide
  Description of Combined DNA/RNA Molecule: Synthetic oligonucleotide
gagcauggaaucccggccctt

SEQ ID NO: 760 - DNA, 21 bp, Artificial Sequence
  Description of Artificial Sequence: Synthetic oligonucleotide
  Description of Combined DNA/RNA Molecule: Synthetic oligonucleotide
gggccgggauuccaugcuctt

SEQ ID NO: 761 - DNA, 21 bp, Artificial Sequence
  Description of Artificial Sequence: Synthetic oligonucleotide
  Description of Combined DNA/RNA Molecule: Synthetic oligonucleotide
gagcauggaaucccggccctt

SEQ ID NO: 762 - DNA, 21 bp, Artificial Sequence
  Description of Artificial Sequence: Synthetic oligonucleotide
  Description of Combined DNA/RNA Molecule: Synthetic oligonucleotide
gggccgggauuccaugcuctt

SEQ ID NO: 763 - DNA, 21 bp, Artificial Sequence
  Description of Artificial Sequence: Synthetic oligonucleotide
  Description of Combined DNA/RNA Molecule: Synthetic oligonucleotide
gccuacgccguagacaacatt

SEQ ID NO: 764 - DNA, 21 bp, Artificial Sequence
  Description of Artificial Sequence: Synthetic oligonucleotide
  Description of Combined DNA/RNA Molecule: Synthetic oligonucleotide
uguugucuacggcguaggctt

SEQ ID NO: 765 - DNA, 21 bp, Artificial Sequence
  Description of Artificial Sequence: Synthetic oligonucleotide
  Description of Combined DNA/RNA Molecule: Synthetic oligonucleotide
ccuacgccguagacaacactt

SEQ ID NO: 766 - DNA, 21 bp, Artificial Sequence
  Description of Artificial Sequence: Synthetic oligonucleotide
  Description of Combined DNA/RNA Molecule: Synthetic oligonucleotide
guguugucuacggcguaggtt

SEQ ID NO: 767 - DNA, 21 bp, Artificial Sequence
  Description of Artificial Sequence: Synthetic oligonucleotide
  Description of Combined DNA/RNA Molecule: Synthetic oligonucleotide
cuacgccguagacaacacgtt

SEQ ID NO: 768 - DNA, 21 bp, Artificial Sequence
  Description of Artificial Sequence: Synthetic oligonucleotide
  Description of Combined DNA/RNA Molecule: Synthetic oligonucleotide
cguguugucuacggcguagtt

SEQ ID NO: 769 - DNA, 21 bp, Artificial Sequence
  Description of Artificial Sequence: Synthetic oligonucleotide
  Description of Combined DNA/RNA Molecule: Synthetic oligonucleotide
uacgccguagacaacacgutt

SEQ ID NO: 770 - DNA, 21 bp, Artificial Sequence
  Description of Artificial Sequence: Synthetic oligonucleotide
  Description of Combined DNA/RNA Molecule: Synthetic oligonucleotide
acguguugucuacggcguatt

SEQ ID NO: 771 - DNA, 21 bp, Artificial Sequence
  Description of Artificial Sequence: Synthetic oligonucleotide
  Description of Combined DNA/RNA Molecule: Synthetic oligonucleotide
cgccguagacaacacgugutt

SEQ ID NO: 772 - DNA, 21 bp, Artificial Sequence
  Description of Artificial Sequence: Synthetic oligonucleotide
  Description of Combined DNA/RNA Molecule: Synthetic oligonucleotide
acacguguugucuacggcgtt

SEQ ID NO: 773 - DNA, 21 bp, Artificial Sequence
  Description of Artificial Sequence: Synthetic oligonucleotide
  Description of Combined DNA/RNA Molecule: Synthetic oligonucleotide
gccguagacaacacgugugtt

SEQ ID NO: 774 - DNA, 21 bp, Artificial Sequence
  Description of Artificial Sequence: Synthetic oligonucleotide
  Description of Combined DNA/RNA Molecule: Synthetic oligonucleotide
cacacguguugucuacggctt

SEQ ID NO: 775 - DNA, 21 bp, Artificial Sequence
  Description of Artificial Sequence: Synthetic oligonucleotide
  Description of Combined DNA/RNA Molecule: Synthetic oligonucleotide
ccguagacaacacgugugutt

SEQ ID NO: 776 - DNA, 21 bp, Artificial Sequence
  Description of Artificial Sequence: Synthetic oligonucleotide
  Description of Combined DNA/RNA Molecule: Synthetic oligonucleotide
acacacguguugucuacggtt

SEQ ID NO: 777 - DNA, 21 bp, Artificial Sequence
  Description of Artificial Sequence: Synthetic oligonucleotide
  Description of Combined DNA/RNA Molecule: Synthetic oligonucleotide
cguagacaacacguguguatt

SEQ ID NO: 778 - DNA, 21 bp, Artificial Sequence
  Description of Artificial Sequence: Synthetic oligonucleotide
  Description of Combined DNA/RNA Molecule: Synthetic oligonucleotide
uacacacguguugucuacgtt

SEQ ID NO: 779 - DNA, 21 bp, Artificial Sequence
  Description of Artificial Sequence: Synthetic oligonucleotide
  Description of Combined DNA/RNA Molecule: Synthetic oligonucleotide
uagacaacacguguguagutt

SEQ ID NO: 780 - DNA, 21 bp, Artificial Sequence
  Description of Artificial Sequence: Synthetic oligonucleotide
  Description of Combined DNA/RNA Molecule: Synthetic oligonucleotide
acuacacacguguugucuatt

SEQ ID NO: 781 - DNA, 21 bp, Artificial Sequence
  Description of Artificial Sequence: Synthetic oligonucleotide
  Description of Combined DNA/RNA Molecule: Synthetic oligonucleotide
agacaacacguguguaguctt

SEQ ID NO: 782 - DNA, 21 bp, Artificial Sequence
  Description of Artificial Sequence: Synthetic oligonucleotide
  Description of Combined DNA/RNA Molecule: Synthetic oligonucleotide
gacuacacacguguugucutt

SEQ ID NO: 783 - DNA, 21 bp, Artificial Sequence
  Description of Artificial Sequence: Synthetic oligonucleotide
  Description of Combined DNA/RNA Molecule: Synthetic oligonucleotide
gacaacacguguguagucatt

SEQ ID NO: 784 - DNA, 21 bp, Artificial Sequence
  Description of Artificial Sequence: Synthetic oligonucleotide
  Description of Combined DNA/RNA Molecule: Synthetic oligonucleotide
ugacuacacacguguuguctt

SEQ ID NO: 785 - DNA, 21 bp, Artificial Sequence
  Description of Artificial Sequence: Synthetic oligonucleotide
  Description of Combined DNA/RNA Molecule: Synthetic oligonucleotide
acaacacguguguagucagtt

SEQ ID NO: 786 - DNA, 21 bp, Artificial Sequence
  Description of Artificial Sequence: Synthetic oligonucleotide
  Description of Combined DNA/RNA Molecule: Synthetic oligonucleotide
cugacuacacacguguugutt

SEQ ID NO: 787 - DNA, 21 bp, Artificial Sequence
  Description of Artificial Sequence: Synthetic oligonucleotide
  Description of Combined DNA/RNA Molecule: Synthetic oligonucleotide
caacacguguguagucaggtt

SEQ ID NO: 788 - DNA, 21 bp, Artificial Sequence
  Description of Artificial Sequence: Synthetic oligonucleotide
  Description of Combined DNA/RNA Molecule: Synthetic oligonucleotide
ccugacuacacacguguugtt

SEQ ID NO: 789 - DNA, 21 bp, Artificial Sequence
  Description of Artificial Sequence: Synthetic oligonucleotide
  Description of Combined DNA/RNA Molecule: Synthetic oligonucleotide
cacguguguagucaggagctt

SEQ ID NO: 790 - DNA, 21 bp, Artificial Sequence
  Description of Artificial Sequence: Synthetic oligonucleotide
  Description of Combined DNA/RNA Molecule: Synthetic oligonucleotide
gcuccugacuacacacgugtt

SEQ ID NO: 791 - DNA, 21 bp, Artificial Sequence
  Description of Artificial Sequence: Synthetic oligonucleotide
  Description of Combined DNA/RNA Molecule: Synthetic oligonucleotide
acguguguagucaggagcctt

SEQ ID NO: 792 - DNA, 21 bp, Artificial Sequence
  Description of Artificial Sequence: Synthetic oligonucleotide
  Description of Combined DNA/RNA Molecule: Synthetic oligonucleotide
ggcuccugacuacacacgutt

SEQ ID NO: 793 - DNA, 21 bp, Artificial Sequence
  Description of Artificial Sequence: Synthetic oligonucleotide
  Description of Combined DNA/RNA Molecule: Synthetic oligonucleotide
cguguguagucaggagccgtt

SEQ ID NO: 794 - DNA, 21 bp, Artificial Sequence
  Description of Artificial Sequence: Synthetic oligonucleotide
  Description of Combined DNA/RNA Molecule: Synthetic oligonucleotide
cggcuccugacuacacacgtt

SEQ ID NO: 795 - DNA, 21 bp, Artificial Sequence
  Description of Artificial Sequence: Synthetic oligonucleotide
  Description of Combined DNA/RNA Molecule: Synthetic oligonucleotide
uguguagucaggagccgggtt

SEQ ID NO: 796 - DNA, 21 bp, Artificial Sequence
  Description of Artificial Sequence: Synthetic oligonucleotide
  Description of Combined DNA/RNA Molecule: Synthetic oligonucleotide
cccggcuccugacuacacatt

SEQ ID NO: 797 - DNA, 21 bp, Artificial Sequence
  Description of Artificial Sequence: Synthetic oligonucleotide
  Description of Combined DNA/RNA Molecule: Synthetic oligonucleotide
gucaggagccgggacgucatt

SEQ ID NO: 798 - DNA, 21 bp, Artificial Sequence
  Description of Artificial Sequence: Synthetic oligonucleotide
  Description of Combined DNA/RNA Molecule: Synthetic oligonucleotide
ugacgucccggcuccugactt

SEQ ID NO: 799 - DNA, 21 bp, Artificial Sequence
  Description of Artificial Sequence: Synthetic oligonucleotide
  Description of Combined DNA/RNA Molecule: Synthetic oligonucleotide
gucaggagccgggacgucatt

SEQ ID NO: 800 - DNA, 21 bp, Artificial Sequence
  Description of Artificial Sequence: Synthetic oligonucleotide
  Description of Combined DNA/RNA Molecule: Synthetic oligonucleotide
ugacgucccggcuccugactt

SEQ ID NO: 801 - DNA, 21 bp, Artificial Sequence
  Description of Artificial Sequence: Synthetic oligonucleotide
  Description of Combined DNA/RNA Molecule: Synthetic oligonucleotide
ucaggagccgggacgucagtt

SEQ ID NO: 802 - DNA, 21 bp, Artificial Sequence
  Description of Artificial Sequence: Synthetic oligonucleotide
  Description of Combined DNA/RNA Molecule: Synthetic oligonucleotide
cugacgucccggcuccugatt

SEQ ID NO: 803 - DNA, 21 bp, Artificial Sequence
  Description of Artificial Sequence: Synthetic oligonucleotide
  Description of Combined DNA/RNA Molecule: Synthetic oligonucleotide
ucaggagccgggacgucagtt

SEQ ID NO: 804 - DNA, 21 bp, Artificial Sequence
  Description of Artificial Sequence: Synthetic oligonucleotide
  Description of Combined DNA/RNA Molecule: Synthetic oligonucleotide
cugacgucccggcuccugatt

SEQ ID NO: 805 - DNA, 21 bp, Artificial Sequence
  Description of Artificial Sequence: Synthetic oligonucleotide
  Description of Combined DNA/RNA Molecule: Synthetic oligonucleotide
caggagccgggacgucagctt

SEQ ID NO: 806 - DNA, 21 bp, Artificial Sequence
  Description of Artificial Sequence: Synthetic oligonucleotide
  Description of Combined DNA/RNA Molecule: Synthetic oligonucleotide
gcugacgucccggcuccugtt

SEQ ID NO: 807 - DNA, 21 bp, Artificial Sequence
  Description of Artificial Sequence: Synthetic oligonucleotide
  Description of Combined DNA/RNA Molecule: Synthetic oligonucleotide
caggagccgggacgucagctt

SEQ ID NO: 808 - DNA, 21 bp, Artificial Sequence
  Description of Artificial Sequence: Synthetic oligonucleotide
  Description of Combined DNA/RNA Molecule: Synthetic oligonucleotide
gcugacgucccggcuccugtt

SEQ ID NO: 809 - DNA, 21 bp, Artificial Sequence
  Description of Artificial Sequence: Synthetic oligonucleotide
  Description of Combined DNA/RNA Molecule: Synthetic oligonucleotide
agccgggacgucagcacuatt

SEQ ID NO: 810 - DNA, 21 bp, Artificial Sequence
  Description of Artificial Sequence: Synthetic oligonucleotide
  Description of Combined DNA/RNA Molecule: Synthetic oligonucleotide
uagugcugacgucccggcutt

SEQ ID NO: 811 - DNA, 21 bp, Artificial Sequence
  Description of Artificial Sequence: Synthetic oligonucleotide
  Description of Combined DNA/RNA Molecule: Synthetic oligonucleotide
ccgggacgucagcacuacatt

SEQ ID NO: 812 - DNA, 21 bp, Artificial Sequence
  Description of Artificial Sequence: Synthetic oligonucleotide
  Description of Combined DNA/RNA Molecule: Synthetic oligonucleotide
uguagugcugacgucccggtt

SEQ ID NO: 813 - DNA, 21 bp, Artificial Sequence
  Description of Artificial Sequence: Synthetic oligonucleotide
  Description of Combined DNA/RNA Molecule: Synthetic oligonucleotide
ccgugacagccguugccautt

SEQ ID NO: 814 - DNA, 21 bp, Artificial Sequence
  Description of Artificial Sequence: Synthetic oligonucleotide
  Description of Combined DNA/RNA Molecule: Synthetic oligonucleotide
auggcaacggcugucacggtt

SEQ ID NO: 815 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 816 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 817 - DNA, 21 bp, Artificial Sequence
  Description of Artificial Sequence: Synthetic oligonucleotide
  Description of Combined DNA/RNA Molecule: Synthetic oligonucleotide
cccaucccaggaugggugutt

SEQ ID NO: 818 - DNA, 21 bp, Artificial Sequence
  Description of Artificial Sequence: Synthetic oligonucleotide
  Description of Combined DNA/RNA Molecule: Synthetic oligonucleotide
acacccauccugggaugggtt

SEQ ID NO: 819 - DNA, 21 bp, Artificial Sequence
  Description of Artificial Sequence: Synthetic oligonucleotide
  Description of Combined DNA/RNA Molecule: Synthetic oligonucleotide
caucccaggaugggugucutt

SEQ ID NO: 820 - DNA, 21 bp, Artificial Sequence
  Description of Artificial Sequence: Synthetic oligonucleotide
  Description of Combined DNA/RNA Molecule: Synthetic oligonucleotide
agacacccauccugggaugtt

SEQ ID NO: 821 - DNA, 21 bp, Artificial Sequence
  Description of Artificial Sequence: Synthetic oligonucleotide
  Description of Combined DNA/RNA Molecule: Synthetic oligonucleotide
agcuuuaaaaugguuccgatt

SEQ ID NO: 822 - DNA, 21 bp, Artificial Sequence
  Description of Artificial Sequence: Synthetic oligonucleotide
  Description of Combined DNA/RNA Molecule: Synthetic oligonucleotide
ucggaaccauuuuaaagcutt

SEQ ID NO: 823 - DNA, 21 bp, Artificial Sequence
  Description of Artificial Sequence: Synthetic oligonucleotide
  Description of Combined DNA/RNA Molecule: Synthetic oligonucleotide
gcuuuaaaaugguuccgactt

SEQ ID NO: 824 - DNA, 21 bp, Artificial Sequence
  Description of Artificial Sequence: Synthetic oligonucleotide
  Description of Combined DNA/RNA Molecule: Synthetic oligonucleotide
gucggaaccauuuuaaagctt

SEQ ID NO: 825 - DNA, 21 bp, Artificial Sequence
  Description of Artificial Sequence: Synthetic oligonucleotide
  Description of Combined DNA/RNA Molecule: Synthetic oligonucleotide
cuuuaaaaugguuccgacutt

SEQ ID NO: 826 - DNA, 21 bp, Artificial Sequence
  Description of Artificial Sequence: Synthetic oligonucleotide
  Description of Combined DNA/RNA Molecule: Synthetic oligonucleotide
agucggaaccauuuuaaagtt

SEQ ID NO: 827 - DNA, 21 bp, Artificial Sequence
  Description of Artificial Sequence: Synthetic oligonucleotide
  Description of Combined DNA/RNA Molecule: Synthetic oligonucleotide
uuuaaaaugguuccgacuutt

SEQ ID NO: 828 - DNA, 21 bp, Artificial Sequence
  Description of Artificial Sequence: Synthetic oligonucleotide
  Description of Combined DNA/RNA Molecule: Synthetic oligonucleotide
aagucggaaccauuuuaaatt

SEQ ID NO: 829 - DNA, 21 bp, Artificial Sequence
  Description of Artificial Sequence: Synthetic oligonucleotide
  Description of Combined DNA/RNA Molecule: Synthetic oligonucleotide
uuaaaaugguuccgacuugtt

SEQ ID NO: 830 - DNA, 21 bp, Artificial Sequence
  Description of Artificial Sequence: Synthetic oligonucleotide
  Description of Combined DNA/RNA Molecule: Synthetic oligonucleotide
caagucggaaccauuuuaatt

SEQ ID NO: 831 - DNA, 21 bp, Artificial Sequence
  Description of Artificial Sequence: Synthetic oligonucleotide
  Description of Combined DNA/RNA Molecule: Synthetic oligonucleotide
uaaaaugguuccgacuugutt

SEQ ID NO: 832 - DNA, 21 bp, Artificial Sequence
  Description of Artificial Sequence: Synthetic oligonucleotide
  Description of Combined DNA/RNA Molecule: Synthetic oligonucleotide
acaagucggaaccauuuuatt

SEQ ID NO: 833 - DNA, 21 bp, Artificial Sequence
  Description of Artificial Sequence: Synthetic oligonucleotide
  Description of Combined DNA/RNA Molecule: Synthetic oligonucleotide
aaaaugguuccgacuuguctt

SEQ ID NO: 834 - DNA, 21 bp, Artificial Sequence
  Description of Artificial Sequence: Synthetic oligonucleotide
  Description of Combined DNA/RNA Molecule: Synthetic oligonucleotide
gacaagucggaaccauuuutt

SEQ ID NO: 835 - DNA, 21 bp, Artificial Sequence
  Description of Artificial Sequence: Synthetic oligonucleotide
  Description of Combined DNA/RNA Molecule: Synthetic oligonucleotide
aaaugguuccgacuugucctt

SEQ ID NO: 836 - DNA, 21 bp, Artificial Sequence
  Description of Artificial Sequence: Synthetic oligonucleotide
  Description of Combined DNA/RNA Molecule: Synthetic oligonucleotide
ggacaagucggaaccauuutt

SEQ ID NO: 837 - DNA, 21 bp, Artificial Sequence
  Description of Artificial Sequence: Synthetic oligonucleotide
  Description of Combined DNA/RNA Molecule: Synthetic oligonucleotide
aaugguuccgacuuguccctt

SEQ ID NO: 838 - DNA, 21 bp, Artificial Sequence
  Description of Artificial Sequence: Synthetic oligonucleotide
  Description of Combined DNA/RNA Molecule: Synthetic oligonucleotide
gggacaagucggaaccauutt

SEQ ID NO: 839 - DNA, 21 bp, Artificial Sequence
  Description of Artificial Sequence: Synthetic oligonucleotide
  Description of Combined DNA/RNA Molecule: Synthetic oligonucleotide
gguuccgacuugucccucutt

SEQ ID NO: 840 - DNA, 21 bp, Artificial Sequence
  Description of Artificial Sequence: Synthetic oligonucleotide
  Description of Combined DNA/RNA Molecule: Synthetic oligonucleotide
agagggacaagucggaacctt

SEQ ID NO: 841 - DNA, 21 bp, Artificial Sequence
  Description of Artificial Sequence: Synthetic oligonucleotide
  Description of Combined DNA/RNA Molecule: Synthetic oligonucleotide
cuccauggccuggcacgagtt

SEQ ID NO: 842 - DNA, 21 bp, Artificial Sequence
  Description of Artificial Sequence: Synthetic oligonucleotide
  Description of Combined DNA/RNA Molecule: Synthetic oligonucleotide
cucgugccaggccauggagtt

SEQ ID NO: 843 - DNA, 21 bp, Artificial Sequence
  Description of Artificial Sequence: Synthetic oligonucleotide
  Description of Combined DNA/RNA Molecule: Synthetic oligonucleotide
ccauggccuggcacgagggtt

SEQ ID NO: 844 - DNA, 21 bp, Artificial Sequence
  Description of Artificial Sequence: Synthetic oligonucleotide
  Description of Combined DNA/RNA Molecule: Synthetic oligonucleotide
cccucgugccaggccauggtt

SEQ ID NO: 845 - DNA, 21 bp, Artificial Sequence
  Description of Artificial Sequence: Synthetic oligonucleotide
  Description of Combined DNA/RNA Molecule: Synthetic oligonucleotide
gaacucacucacucugggutt

SEQ ID NO: 846 - DNA, 21 bp, Artificial Sequence
  Description of Artificial Sequence: Synthetic oligonucleotide
  Description of Combined DNA/RNA Molecule: Synthetic oligonucleotide
acccagagugagugaguuctt

SEQ ID NO: 847 - DNA, 21 bp, Artificial Sequence
  Description of Artificial Sequence: Synthetic oligonucleotide
  Description of Combined DNA/RNA Molecule: Synthetic oligonucleotide
ucacucacucugggugccutt

SEQ ID NO: 848 - DNA, 21 bp, Artificial Sequence
  Description of Artificial Sequence: Synthetic oligonucleotide
  Description of Combined DNA/RNA Molecule: Synthetic oligonucleotide
aggcacccagagugagugatt

SEQ ID NO: 849 - DNA, 21 bp, Artificial Sequence
  Description of Artificial Sequence: Synthetic oligonucleotide
  Description of Combined DNA/RNA Molecule: Synthetic oligonucleotide
uuucaccauucaaacaggutt

SEQ ID NO: 850 - DNA, 21 bp, Artificial Sequence
  Description of Artificial Sequence: Synthetic oligonucleotide
  Description of Combined DNA/RNA Molecule: Synthetic oligonucleotide
accuguuugaauggugaaatt

SEQ ID NO: 851 - DNA, 21 bp, Artificial Sequence
  Description of Artificial Sequence: Synthetic oligonucleotide
  Description of Combined DNA/RNA Molecule: Synthetic oligonucleotide
cauucaaacaggucgagcutt

SEQ ID NO: 852 - DNA, 21 bp, Artificial Sequence
  Description of Artificial Sequence: Synthetic oligonucleotide
  Description of Combined DNA/RNA Molecule: Synthetic oligonucleotide
agcucgaccuguuugaaugtt

SEQ ID NO: 853 - DNA, 21 bp, Artificial Sequence
  Description of Artificial Sequence: Synthetic oligonucleotide
  Description of Combined DNA/RNA Molecule: Synthetic oligonucleotide
auucaaacaggucgagcugtt

SEQ ID NO: 854 - DNA, 21 bp, Artificial Sequence
  Description of Artificial Sequence: Synthetic oligonucleotide
  Description of Combined DNA/RNA Molecule: Synthetic oligonucleotide
cagcucgaccuguuugaautt

SEQ ID NO: 855 - DNA, 21 bp, Artificial Sequence
  Description of Artificial Sequence: Synthetic oligonucleotide
  Description of Combined DNA/RNA Molecule: Synthetic oligonucleotide
uucaaacaggucgagcugutt

SEQ ID NO: 856 - DNA, 21 bp, Artificial Sequence
  Description of Artificial Sequence: Synthetic oligonucleotide
  Description of Combined DNA/RNA Molecule: Synthetic oligonucleotide
acagcucgaccuguuugaatt

SEQ ID NO: 857 - DNA, 21 bp, Artificial Sequence
  Description of Artificial Sequence: Synthetic oligonucleotide
  Description of Combined DNA/RNA Molecule: Synthetic oligonucleotide
ucaaacaggucgagcugugtt

SEQ ID NO: 858 - DNA, 21 bp, Artificial Sequence
  Description of Artificial Sequence: Synthetic oligonucleotide
  Description of Combined DNA/RNA Molecule: Synthetic oligonucleotide
cacagcucgaccuguuugatt

SEQ ID NO: 859 - DNA, 21 bp, Artificial Sequence
  Description of Artificial Sequence: Synthetic oligonucleotide
  Description of Combined DNA/RNA Molecule: Synthetic oligonucleotide
caaacaggucgagcugugctt

SEQ ID NO: 860 - DNA, 21 bp, Artificial Sequence
  Description of Artificial Sequence: Synthetic oligonucleotide
  Description of Combined DNA/RNA Molecule: Synthetic oligonucleotide
gcacagcucgaccuguuugtt

SEQ ID NO: 861 - DNA, 21 bp, Artificial Sequence
  Description of Artificial Sequence: Synthetic oligonucleotide
  Description of Combined DNA/RNA Molecule: Synthetic oligonucleotide
aaacaggucgagcugugcutt

SEQ ID NO: 862 - DNA, 21 bp, Artificial Sequence
  Description of Artificial Sequence: Synthetic oligonucleotide
  Description of Combined DNA/RNA Molecule: Synthetic oligonucleotide
agcacagcucgaccuguuutt

SEQ ID NO: 863 - DNA, 21 bp, Artificial Sequence
  Description of Artificial Sequence: Synthetic oligonucleotide
  Description of Combined DNA/RNA Molecule: Synthetic oligonucleotide
aacaggucgagcugugcuctt

SEQ ID NO: 864 - DNA, 21 bp, Artificial Sequence
  Description of Artificial Sequence: Synthetic oligonucleotide
  Description of Combined DNA/RNA Molecule: Synthetic oligonucleotide
gagcacagcucgaccuguutt

SEQ ID NO: 865 - DNA, 21 bp, Artificial Sequence
  Description of Artificial Sequence: Synthetic oligonucleotide
  Description of Combined DNA/RNA Molecule: Synthetic oligonucleotide
caggucgagcugugcucggtt

SEQ ID NO: 866 - DNA, 21 bp, Artificial Sequence
  Description of Artificial Sequence: Synthetic oligonucleotide
  Description of Combined DNA/RNA Molecule: Synthetic oligonucleotide
ccgagcacagcucgaccugtt

SEQ ID NO: 867 - DNA, 21 bp, Artificial Sequence
  Description of Artificial Sequence: Synthetic oligonucleotide
  Description of Combined DNA/RNA Molecule: Synthetic oligonucleotide
aggucgagcugugcucgggtt

SEQ ID NO: 868 - DNA, 21 bp, Artificial Sequence
  Description of Artificial Sequence: Synthetic oligonucleotide
  Description of Combined DNA/RNA Molecule: Synthetic oligonucleotide
cccgagcacagcucgaccutt

SEQ ID NO: 869 - DNA, 21 bp, Artificial Sequence
  Description of Artificial Sequence: Synthetic oligonucleotide
  Description of Combined DNA/RNA Molecule: Synthetic oligonucleotide
gucgagcugugcucgggugtt

SEQ ID NO: 870 - DNA, 21 bp, Artificial Sequence
  Description of Artificial Sequence: Synthetic oligonucleotide
  Description of Combined DNA/RNA Molecule: Synthetic oligonucleotide
cacccgagcacagcucgactt

SEQ ID NO: 871 - DNA, 21 bp, Artificial Sequence
  Description of Artificial Sequence: Synthetic oligonucleotide
  Description of Combined DNA/RNA Molecule: Synthetic oligonucleotide
ucgagcugugcucgggugctt

SEQ ID NO: 872 - DNA, 21 bp, Artificial Sequence
  Description of Artificial Sequence: Synthetic oligonucleotide
  Description of Combined DNA/RNA Molecule: Synthetic oligonucleotide
gcacccgagcacagcucgatt

SEQ ID NO: 873 - DNA, 21 bp, Artificial Sequence
  Description of Artificial Sequence: Synthetic oligonucleotide
  Description of Combined DNA/RNA Molecule: Synthetic oligonucleotide
agcugcucccaaugugccgtt

SEQ ID NO: 874 - DNA, 21 bp, Artificial Sequence
  Description of Artificial Sequence: Synthetic oligonucleotide
  Description of Combined DNA/RNA Molecule: Synthetic oligonucleotide
cggcacauugggagcagcutt

SEQ ID NO: 875 - DNA, 21 bp, Artificial Sequence
  Description of Artificial Sequence: Synthetic oligonucleotide
  Description of Combined DNA/RNA Molecule: Synthetic oligonucleotide
gcugcucccaaugugccgatt

SEQ ID NO: 876 - DNA, 21 bp, Artificial Sequence
  Description of Artificial Sequence: Synthetic oligonucleotide
  Description of Combined DNA/RNA Molecule: Synthetic oligonucleotide
ucggcacauugggagcagctt

SEQ ID NO: 877 - DNA, 21 bp, Artificial Sequence
  Description of Artificial Sequence: Synthetic oligonucleotide
  Description of Combined DNA/RNA Molecule: Synthetic oligonucleotide
ugcucccaaugugccgaugtt

SEQ ID NO: 878 - DNA, 21 bp, Artificial Sequence
  Description of Artificial Sequence: Synthetic oligonucleotide
  Description of Combined DNA/RNA Molecule: Synthetic oligonucleotide
caucggcacauugggagcatt

SEQ ID NO: 879 - DNA, 21 bp, Artificial Sequence
  Description of Artificial Sequence: Synthetic oligonucleotide
  Description of Combined DNA/RNA Molecule: Synthetic oligonucleotide
ucccaaugugccgaugucctt

SEQ ID NO: 880 - DNA, 21 bp, Artificial Sequence
  Description of Artificial Sequence: Synthetic oligonucleotide
  Description of Combined DNA/RNA Molecule: Synthetic oligonucleotide
ggacaucggcacauugggatt

SEQ ID NO: 881 - DNA, 21 bp, Artificial Sequence
  Description of Artificial Sequence: Synthetic oligonucleotide
  Description of Combined DNA/RNA Molecule: Synthetic oligonucleotide
ccaaugugccgauguccgutt

SEQ ID NO: 882 - DNA, 21 bp, Artificial Sequence
  Description of Artificial Sequence: Synthetic oligonucleotide
  Description of Combined DNA/RNA Molecule: Synthetic oligonucleotide
acggacaucggcacauuggtt

SEQ ID NO: 883 - DNA, 21 bp, Artificial Sequence
  Description of Artificial Sequence: Synthetic oligonucleotide
  Description of Combined DNA/RNA Molecule: Synthetic oligonucleotide
caaugugccgauguccgugtt

SEQ ID NO: 884 - DNA, 21 bp, Artificial Sequence
  Description of Artificial Sequence: Synthetic oligonucleotide
  Description of Combined DNA/RNA Molecule: Synthetic oligonucleotide
cacggacaucggcacauugtt

SEQ ID NO: 885 - DNA, 21 bp, Artificial Sequence
  Description of Artificial Sequence: Synthetic oligonucleotide
  Description of Combined DNA/RNA Molecule: Synthetic oligonucleotide
aaugugccgauguccguggtt

SEQ ID NO: 886 - DNA, 21 bp, Artificial Sequence
  Description of Artificial Sequence: Synthetic oligonucleotide
  Description of Combined DNA/RNA Molecule: Synthetic oligonucleotide
ccacggacaucggcacauutt

SEQ ID NO: 887 - DNA, 21 bp, Artificial Sequence
  Description of Artificial Sequence: Synthetic oligonucleotide
  Description of Combined DNA/RNA Molecule: Synthetic oligonucleotide
ccgauguccgugggcagaatt

SEQ ID NO: 888 - DNA, 21 bp, Artificial Sequence
  Description of Artificial Sequence: Synthetic oligonucleotide
  Description of Combined DNA/RNA Molecule: Synthetic oligonucleotide
uucugcccacggacaucggtt

SEQ ID NO: 889 - DNA, 21 bp, Artificial Sequence
  Description of Artificial Sequence: Synthetic oligonucleotide
  Description of Combined DNA/RNA Molecule: Synthetic oligonucleotide
gauguccgugggcagaaugtt

SEQ ID NO: 890 - DNA, 21 bp, Artificial Sequence
  Description of Artificial Sequence: Synthetic oligonucleotide
  Description of Combined DNA/RNA Molecule: Synthetic oligonucleotide
cauucugcccacggacauctt

SEQ ID NO: 891 - DNA, 21 bp, Artificial Sequence
  Description of Artificial Sequence: Synthetic oligonucleotide
  Description of Combined DNA/RNA Molecule: Synthetic oligonucleotide
guccgugggcagaaugacutt

SEQ ID NO: 892 - DNA, 21 bp, Artificial Sequence
  Description of Artificial Sequence: Synthetic oligonucleotide
  Description of Combined DNA/RNA Molecule: Synthetic oligonucleotide
agucauucugcccacggactt

SEQ ID NO: 893 - DNA, 21 bp, Artificial Sequence
  Description of Artificial Sequence: Synthetic oligonucleotide
  Description of Combined DNA/RNA Molecule: Synthetic oligonucleotide
uccgugggcagaaugacuutt

SEQ ID NO: 894 - DNA, 21 bp, Artificial Sequence
  Description of Artificial Sequence: Synthetic oligonucleotide
  Description of Combined DNA/RNA Molecule: Synthetic oligonucleotide
aagucauucugcccacggatt

SEQ ID NO: 895 - DNA, 21 bp, Artificial Sequence
  Description of Artificial Sequence: Synthetic oligonucleotide
  Description of Combined DNA/RNA Molecule: Synthetic oligonucleotide
ugggcagaaugacuuuuautt

SEQ ID NO: 896 - DNA, 21 bp, Artificial Sequence
  Description of Artificial Sequence: Synthetic oligonucleotide
  Description of Combined DNA/RNA Molecule: Synthetic oligonucleotide
auaaaagucauucugcccatt

SEQ ID NO: 897 - DNA, 21 bp, Artificial Sequence
  Description of Artificial Sequence: Synthetic oligonucleotide
  Description of Combined DNA/RNA Molecule: Synthetic oligonucleotide
acuuuuauugagcucuugutt

SEQ ID NO: 898 - DNA, 21 bp, Artificial Sequence
  Description of Artificial Sequence: Synthetic oligonucleotide
  Description of Combined DNA/RNA Molecule: Synthetic oligonucleotide
acaagagcucaauaaaagutt

SEQ ID NO: 899 - DNA, 21 bp, Artificial Sequence
  Description of Artificial Sequence: Synthetic oligonucleotide
  Description of Combined DNA/RNA Molecule: Synthetic oligonucleotide
auugagcucuuguuccgugtt

SEQ ID NO: 900 - DNA, 21 bp, Artificial Sequence
  Description of Artificial Sequence: Synthetic oligonucleotide
  Description of Combined DNA/RNA Molecule: Synthetic oligonucleotide
cacggaacaagagcucaautt

SEQ ID NO: 901 - DNA, 21 bp, Artificial Sequence
  Description of Artificial Sequence: Synthetic oligonucleotide
  Description of Combined DNA/RNA Molecule: Synthetic oligonucleotide
agcucuuguuccgugccagtt

SEQ ID NO: 902 - DNA, 21 bp, Artificial Sequence
  Description of Artificial Sequence: Synthetic oligonucleotide
  Description of Combined DNA/RNA Molecule: Synthetic oligonucleotide
cuggcacggaacaagagcutt

SEQ ID NO: 903 - DNA, 21 bp, Artificial Sequence
  Description of Artificial Sequence: Synthetic oligonucleotide
  Description of Combined DNA/RNA Molecule: Synthetic oligonucleotide
gcucuuguuccgugccaggtt

SEQ ID NO: 904 - DNA, 21 bp, Artificial Sequence
  Description of Artificial Sequence: Synthetic oligonucleotide
  Description of Combined DNA/RNA Molecule: Synthetic oligonucleotide
ccuggcacggaacaagagctt

SEQ ID NO: 905 - DNA, 21 bp, Artificial Sequence
  Description of Artificial Sequence: Synthetic oligonucleotide
  Description of Combined DNA/RNA Molecule: Synthetic oligonucleotide
uguuccgugccaggcauuctt

SEQ ID NO: 906 - DNA, 21 bp, Artificial Sequence
  Description of Artificial Sequence: Synthetic oligonucleotide
  Description of Combined DNA/RNA Molecule: Synthetic oligonucleotide
gaaugccuggcacggaacatt

SEQ ID NO: 907 - DNA, 21 bp, Artificial Sequence
  Description of Artificial Sequence: Synthetic oligonucleotide
  Description of Combined DNA/RNA Molecule: Synthetic oligonucleotide
guuccgugccaggcauucatt

SEQ ID NO: 908 - DNA, 21 bp, Artificial Sequence
  Description of Artificial Sequence: Synthetic oligonucleotide
  Description of Combined DNA/RNA Molecule: Synthetic oligonucleotide
ugaaugccuggcacggaactt

SEQ ID NO: 909 - DNA, 21 bp, Artificial Sequence
  Description of Artificial Sequence: Synthetic oligonucleotide
  Description of Combined DNA/RNA Molecule: Synthetic oligonucleotide
uuccgugccaggcauucaatt

SEQ ID NO: 910 - DNA, 21 bp, Artificial Sequence
  Description of Artificial Sequence: Synthetic oligonucleotide
  Description of Combined DNA/RNA Molecule: Synthetic oligonucleotide
uugaaugccuggcacggaatt

SEQ ID NO: 911 - DNA, 21 bp, Artificial Sequence
  Description of Artificial Sequence: Synthetic oligonucleotide
  Description of Combined DNA/RNA Molecule: Synthetic oligonucleotide
cgugccaggcauucaaucctt

SEQ ID NO: 912 - DNA, 21 bp, Artificial Sequence
  Description of Artificial Sequence: Synthetic oligonucleotide
  Description of Combined DNA/RNA Molecule: Synthetic oligonucleotide
ggauugaaugccuggcacgtt

SEQ ID NO: 913 - DNA, 21 bp, Artificial Sequence
  Description of Artificial Sequence: Synthetic oligonucleotide
  Description of Combined DNA/RNA Molecule: Synthetic oligonucleotide
gugccaggcauucaauccutt

SEQ ID NO: 914 - DNA, 21 bp, Artificial Sequence
  Description of Artificial Sequence: Synthetic oligonucleotide
  Description of Combined DNA/RNA Molecule: Synthetic oligonucleotide
aggauugaaugccuggcactt

SEQ ID NO: 915 - DNA, 21 bp, Artificial Sequence
  Description of Artificial Sequence: Synthetic oligonucleotide
  Description of Combined DNA/RNA Molecule: Synthetic oligonucleotide
caauccucaggucuccacctt

SEQ ID NO: 916 - DNA, 21 bp, Artificial Sequence
  Description of Artificial Sequence: Synthetic oligonucleotide
  Description of Combined DNA/RNA Molecule: Synthetic oligonucleotide
gguggagaccugaggauugtt

SEQ ID NO: 917 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 918 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 919 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 920 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 921 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 922 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 923 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 924 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 925 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 926 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 927 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 928 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 929 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 930 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 931 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 932 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 933 - DNA, 21 bp, Artificial Sequence
  Description of Artificial Sequence: Synthetic oligonucleotide
  Description of Combined DNA/RNA Molecule: Synthetic oligonucleotide
caccaaggaggcaggauuctt

SEQ ID NO: 934 - DNA, 21 bp, Artificial Sequence
  Description of Artificial Sequence: Synthetic oligonucleotide
  Description of Combined DNA/RNA Molecule: Synthetic oligonucleotide
gaauccugccuccuuggugtt

SEQ ID NO: 935 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 936 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 937 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 938 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 939 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 940 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 941 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 942 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 943 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 944 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 945 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 946 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 947 - DNA, 21 bp, Artificial Sequence
  Description of Artificial Sequence: Synthetic oligonucleotide
  Description of Combined DNA/RNA Molecule: Synthetic oligonucleotide
ggccuggaguuuauucggatt

SEQ ID NO: 948 - DNA, 21 bp, Artificial Sequence
  Description of Artificial Sequence: Synthetic oligonucleotide
  Description of Combined DNA/RNA Molecule: Synthetic oligonucleotide
uccgaauaaacuccaggcctt

SEQ ID NO: 949 - DNA, 21 bp, Artificial Sequence
  Description of Artificial Sequence: Synthetic oligonucleotide
  Description of Combined DNA/RNA Molecule: Synthetic oligonucleotide
gcaggauucuucccauggatt

SEQ ID NO: 950 - DNA, 21 bp, Artificial Sequence
  Description of Artificial Sequence: Synthetic oligonucleotide
  Description of Combined DNA/RNA Molecule: Synthetic oligonucleotide
uccaugggaagaauccugctt

SEQ ID NO: 951 - DNA, 21 bp, Artificial Sequence
  Description of Artificial Sequence: Synthetic oligonucleotide
  Description of Combined DNA/RNA Molecule: Synthetic oligonucleotide
ugcagggacaaacaucguutt

SEQ ID NO: 952 - DNA, 21 bp, Artificial Sequence
  Description of Artificial Sequence: Synthetic oligonucleotide
  Description of Combined DNA/RNA Molecule: Synthetic oligonucleotide
aacgauguuugucccugcatt

SEQ ID NO: 953 - DNA, 21 bp, Artificial Sequence
  Description of Artificial Sequence: Synthetic oligonucleotide
  Description of Combined DNA/RNA Molecule: Synthetic oligonucleotide
gcagggacaaacaucguugtt

SEQ ID NO: 954 - DNA, 21 bp, Artificial Sequence
  Description of Artificial Sequence: Synthetic oligonucleotide
  Description of Combined DNA/RNA Molecule: Synthetic oligonucleotide
caacgauguuugucccugctt

SEQ ID NO: 955 - DNA, 21 bp, Artificial Sequence
  Description of Artificial Sequence: Synthetic oligonucleotide
  Description of Combined DNA/RNA Molecule: Synthetic oligonucleotide
agggacaaacaucguugggtt

SEQ ID NO: 956 - DNA, 21 bp, Artificial Sequence
  Description of Artificial Sequence: Synthetic oligonucleotide
  Description of Combined DNA/RNA Molecule: Synthetic oligonucleotide
cccaacgauguuugucccutt

SEQ ID NO: 957 - DNA, 21 bp, Artificial Sequence
  Description of Artificial Sequence: Synthetic oligonucleotide
  Description of Combined DNA/RNA Molecule: Synthetic oligonucleotide
cccucaucuccagcuaacutt

SEQ ID NO: 958 - DNA, 21 bp, Artificial Sequence
  Description of Artificial Sequence: Synthetic oligonucleotide
  Description of Combined DNA/RNA Molecule: Synthetic oligonucleotide
aguuagcuggagaugagggtt

SEQ ID NO: 959 - DNA, 21 bp, Artificial Sequence
  Description of Artificial Sequence: Synthetic oligonucleotide
  Description of Combined DNA/RNA Molecule: Synthetic oligonucleotide
caucuccagcuaacuguggtt

SEQ ID NO: 960 - DNA, 21 bp, Artificial Sequence
  Description of Artificial Sequence: Synthetic oligonucleotide
  Description of Combined DNA/RNA Molecule: Synthetic oligonucleotide
ccacaguuagcuggagaugtt

SEQ ID NO: 961 - DNA, 21 bp, Artificial Sequence
  Description of Artificial Sequence: Synthetic oligonucleotide
  Description of Combined DNA/RNA Molecule: Synthetic oligonucleotide
gcucccugauuaauggaggtt

SEQ ID NO: 962 - DNA, 21 bp, Artificial Sequence
  Description of Artificial Sequence: Synthetic oligonucleotide
  Description of Combined DNA/RNA Molecule: Synthetic oligonucleotide
ccuccauuaaucagggagctt

SEQ ID NO: 963 - DNA, 21 bp, Artificial Sequence
  Description of Artificial Sequence: Synthetic oligonucleotide
  Description of Combined DNA/RNA Molecule: Synthetic oligonucleotide
cccugauuaauggaggcuutt

SEQ ID NO: 964 - DNA, 21 bp, Artificial Sequence
  Description of Artificial Sequence: Synthetic oligonucleotide
  Description of Combined DNA/RNA Molecule: Synthetic oligonucleotide
aagccuccauuaaucagggtt

SEQ ID NO: 965 - DNA, 21 bp, Artificial Sequence
  Description of Artificial Sequence: Synthetic oligonucleotide
  Description of Combined DNA/RNA Molecule: Synthetic oligonucleotide
ccugauuaauggaggcuuatt

SEQ ID NO: 966 - DNA, 21 bp, Artificial Sequence
  Description of Artificial Sequence: Synthetic oligonucleotide
  Description of Combined DNA/RNA Molecule: Synthetic oligonucleotide
uaagccuccauuaaucaggtt

SEQ ID NO: 967 - DNA, 21 bp, Artificial Sequence
  Description of Artificial Sequence: Synthetic oligonucleotide
  Description of Combined DNA/RNA Molecule: Synthetic oligonucleotide
ugauuaauggaggcuuagctt

SEQ ID NO: 968 - DNA, 21 bp, Artificial Sequence
  Description of Artificial Sequence: Synthetic oligonucleotide
  Description of Combined DNA/RNA Molecule: Synthetic oligonucleotide
gcuaagccuccauuaaucatt

SEQ ID NO: 969 - DNA, 21 bp, Artificial Sequence
  Description of Artificial Sequence: Synthetic oligonucleotide
  Description of Combined DNA/RNA Molecule: Synthetic oligonucleotide
gauuaauggaggcuuagcutt

SEQ ID NO: 970 - DNA, 21 bp, Artificial Sequence
  Description of Artificial Sequence: Synthetic oligonucleotide
  Description of Combined DNA/RNA Molecule: Synthetic oligonucleotide
agcuaagccuccauuaauctt

SEQ ID NO: 971 - DNA, 21 bp, Artificial Sequence
  Description of Artificial Sequence: Synthetic oligonucleotide
  Description of Combined DNA/RNA Molecule: Synthetic oligonucleotide
auuaauggaggcuuagcuutt

SEQ ID NO: 972 - DNA, 21 bp, Artificial Sequence
  Description of Artificial Sequence: Synthetic oligonucleotide
  Description of Combined DNA/RNA Molecule: Synthetic oligonucleotide
aagcuaagccuccauuaautt

SEQ ID NO: 973 - DNA, 21 bp, Artificial Sequence
  Description of Artificial Sequence: Synthetic oligonucleotide
  Description of Combined DNA/RNA Molecule: Synthetic oligonucleotide
uuaauggaggcuuagcuuutt

SEQ ID NO: 974 - DNA, 21 bp, Artificial Sequence
  Description of Artificial Sequence: Synthetic oligonucleotide
  Description of Combined DNA/RNA Molecule: Synthetic oligonucleotide
aaagcuaagccuccauuaatt

SEQ ID NO: 975 - DNA, 21 bp, Artificial Sequence
  Description of Artificial Sequence: Synthetic oligonucleotide
  Description of Combined DNA/RNA Molecule: Synthetic oligonucleotide
uuucuggauggcaucuagctt

SEQ ID NO: 976 - DNA, 21 bp, Artificial Sequence
  Description of Artificial Sequence: Synthetic oligonucleotide
  Description of Combined DNA/RNA Molecule: Synthetic oligonucleotide
gcuagaugccauccagaaatt

SEQ ID NO: 977 - DNA, 21 bp, Artificial Sequence
  Description of Artificial Sequence: Synthetic oligonucleotide
  Description of Combined DNA/RNA Molecule: Synthetic oligonucleotide
uuucuggauggcaucuagctt

SEQ ID NO: 978 - DNA, 21 bp, Artificial Sequence
  Description of Artificial Sequence: Synthetic oligonucleotide
  Description of Combined DNA/RNA Molecule: Synthetic oligonucleotide
gcuagaugccauccagaaatt

SEQ ID NO: 979 - DNA, 21 bp, Artificial Sequence
  Description of Artificial Sequence: Synthetic oligonucleotide
  Description of Combined DNA/RNA Molecule: Synthetic oligonucleotide
uucuggauggcaucuagcctt

SEQ ID NO: 980 - DNA, 21 bp, Artificial Sequence
  Description of Artificial Sequence: Synthetic oligonucleotide
  Description of Combined DNA/RNA Molecule: Synthetic oligonucleotide
ggcuagaugccauccagaatt

SEQ ID NO: 981 - DNA, 21 bp, Artificial Sequence
  Description of Artificial Sequence: Synthetic oligonucleotide
  Description of Combined DNA/RNA Molecule: Synthetic oligonucleotide
uucuggauggcaucuagcctt

SEQ ID NO: 982 - DNA, 21 bp, Artificial Sequence
  Description of Artificial Sequence: Synthetic oligonucleotide
  Description of Combined DNA/RNA Molecule: Synthetic oligonucleotide
ggcuagaugccauccagaatt

SEQ ID NO: 983 - DNA, 21 bp, Artificial Sequence
  Description of Artificial Sequence: Synthetic oligonucleotide
  Description of Combined DNA/RNA Molecule: Synthetic oligonucleotide
ucuggauggcaucuagccatt

SEQ ID NO: 984 - DNA, 21 bp, Artificial Sequence
  Description of Artificial Sequence: Synthetic oligonucleotide
  Description of Combined DNA/RNA Molecule: Synthetic oligonucleotide
uggcuagaugccauccagatt

SEQ ID NO: 985 - DNA, 21 bp, Artificial Sequence
  Description of Artificial Sequence: Synthetic oligonucleotide
  Description of Combined DNA/RNA Molecule: Synthetic oligonucleotide
ucuggauggcaucuagccatt

SEQ ID NO: 986 - DNA, 21 bp, Artificial Sequence
  Description of Artificial Sequence: Synthetic oligonucleotide
  Description of Combined DNA/RNA Molecule: Synthetic oligonucleotide
uggcuagaugccauccagatt

SEQ ID NO: 987 - DNA, 21 bp, Artificial Sequence
  Description of Artificial Sequence: Synthetic oligonucleotide
  Description of Combined DNA/RNA Molecule: Synthetic oligonucleotide
aggcuggagacaggugcgctt

SEQ ID NO: 988 - DNA, 21 bp, Artificial Sequence
  Description of Artificial Sequence: Synthetic oligonucleotide
  Description of Combined DNA/RNA Molecule: Synthetic oligonucleotide
gcgcaccugucuccagccutt

SEQ ID NO: 989 - DNA, 21 bp, Artificial Sequence
  Description of Artificial Sequence: Synthetic oligonucleotide
  Description of Combined DNA/RNA Molecule: Synthetic oligonucleotide
ggcuggagacaggugcgcctt

SEQ ID NO: 990 - DNA, 21 bp, Artificial Sequence
  Description of Artificial Sequence: Synthetic oligonucleotide
  Description of Combined DNA/RNA Molecule: Synthetic oligonucleotide
ggcgcaccugucuccagcctt

SEQ ID NO: 991 - DNA, 21 bp, Artificial Sequence
  Description of Artificial Sequence: Synthetic oligonucleotide
  Description of Combined DNA/RNA Molecule: Synthetic oligonucleotide
gcuggagacaggugcgccctt

SEQ ID NO: 992 - DNA, 21 bp, Artificial Sequence
  Description of Artificial Sequence: Synthetic oligonucleotide
  Description of Combined DNA/RNA Molecule: Synthetic oligonucleotide
gggcgcaccugucuccagctt

SEQ ID NO: 993 - DNA, 21 bp, Artificial Sequence
  Description of Artificial Sequence: Synthetic oligonucleotide
  Description of Combined DNA/RNA Molecule: Synthetic oligonucleotide
uuccugagccaccuuuacutt

SEQ ID NO: 994 - DNA, 21 bp, Artificial Sequence
  Description of Artificial Sequence: Synthetic oligonucleotide
  Description of Combined DNA/RNA Molecule: Synthetic oligonucleotide
aguaaagguggcucaggaatt

SEQ ID NO: 995 - DNA, 21 bp, Artificial Sequence
  Description of Artificial Sequence: Synthetic oligonucleotide
  Description of Combined DNA/RNA Molecule: Synthetic oligonucleotide
uccugagccaccuuuacuctt

SEQ ID NO: 996 - DNA, 21 bp, Artificial Sequence
  Description of Artificial Sequence: Synthetic oligonucleotide
  Description of Combined DNA/RNA Molecule: Synthetic oligonucleotide
gaguaaagguggcucaggatt

SEQ ID NO: 997 - DNA, 21 bp, Artificial Sequence
  Description of Artificial Sequence: Synthetic oligonucleotide
  Description of Combined DNA/RNA Molecule: Synthetic oligonucleotide
ccugagccaccuuuacucutt

SEQ ID NO: 998 - DNA, 21 bp, Artificial Sequence
  Description of Artificial Sequence: Synthetic oligonucleotide
  Description of Combined DNA/RNA Molecule: Synthetic oligonucleotide
agaguaaagguggcucaggtt

SEQ ID NO: 999 - DNA, 21 bp, Artificial Sequence
  Description of Artificial Sequence: Synthetic oligonucleotide
  Description of Combined DNA/RNA Molecule: Synthetic oligonucleotide
ugagccaccuuuacucugctt

SEQ ID NO: 1000 - DNA, 21 bp, Artificial Sequence
  Description of Artificial Sequence: Synthetic oligonucleotide
  Description of Combined DNA/RNA Molecule: Synthetic oligonucleotide
gcagaguaaagguggcucatt

SEQ ID NO: 1001 - DNA, 21 bp, Artificial Sequence
  Description of Artificial Sequence: Synthetic oligonucleotide
  Description of Combined DNA/RNA Molecule: Synthetic oligonucleotide
agccaccuuuacucugcuctt

SEQ ID NO: 1002 - DNA, 21 bp, Artificial Sequence
  Description of Artificial Sequence: Synthetic oligonucleotide
  Description of Combined DNA/RNA Molecule: Synthetic oligonucleotide
gagcagaguaaagguggcutt

SEQ ID NO: 1003 - DNA, 21 bp, Artificial Sequence
  Description of Artificial Sequence: Synthetic oligonucleotide
  Description of Combined DNA/RNA Molecule: Synthetic oligonucleotide
caccuuuacucugcucuautt

SEQ ID NO: 1004 - DNA, 21 bp, Artificial Sequence
  Description of Artificial Sequence: Synthetic oligonucleotide
  Description of Combined DNA/RNA Molecule: Synthetic oligonucleotide
auagagcagaguaaaggugtt

SEQ ID NO: 1005 - DNA, 21 bp, Artificial Sequence
  Description of Artificial Sequence: Synthetic oligonucleotide
  Description of Combined DNA/RNA Molecule: Synthetic oligonucleotide
uacucugcucuaugccaggtt

SEQ ID NO: 1006 - DNA, 21 bp, Artificial Sequence
  Description of Artificial Sequence: Synthetic oligonucleotide
  Description of Combined DNA/RNA Molecule: Synthetic oligonucleotide
ccuggcauagagcagaguatt

SEQ ID NO: 1007 - DNA, 21 bp, Artificial Sequence
  Description of Artificial Sequence: Synthetic oligonucleotide
  Description of Combined DNA/RNA Molecule: Synthetic oligonucleotide
uacucugcucuaugccaggtt

SEQ ID NO: 1008 - DNA, 21 bp, Artificial Sequence
  Description of Artificial Sequence: Synthetic oligonucleotide
  Description of Combined DNA/RNA Molecule: Synthetic oligonucleotide
ccuggcauagagcagaguatt

SEQ ID NO: 1009 - DNA, 21 bp, Artificial Sequence
  Description of Artificial Sequence: Synthetic oligonucleotide
  Description of Combined DNA/RNA Molecule: Synthetic oligonucleotide
augccaggcugugcuagcatt

SEQ ID NO: 1010 - DNA, 21 bp, Artificial Sequence
  Description of Artificial Sequence: Synthetic oligonucleotide
  Description of Combined DNA/RNA Molecule: Synthetic oligonucleotide
ugcuagcacagccuggcautt

SEQ ID NO: 1011 - DNA, 21 bp, Artificial Sequence
  Description of Artificial Sequence: Synthetic oligonucleotide
  Description of Combined DNA/RNA Molecule: Synthetic oligonucleotide
aggcugugcuagcaacacctt

SEQ ID NO: 1012 - DNA, 21 bp, Artificial Sequence
  Description of Artificial Sequence: Synthetic oligonucleotide
  Description of Combined DNA/RNA Molecule: Synthetic oligonucleotide
gguguugcuagcacagccutt

SEQ ID NO: 1013 - DNA, 21 bp, Artificial Sequence
  Description of Artificial Sequence: Synthetic oligonucleotide
  Description of Combined DNA/RNA Molecule: Synthetic oligonucleotide
cugugcuagcaacacccaatt

SEQ ID NO: 1014 - DNA, 21 bp, Artificial Sequence
  Description of Artificial Sequence: Synthetic oligonucleotide
  Description of Combined DNA/RNA Molecule: Synthetic oligonucleotide
uuggguguugcuagcacagtt

SEQ ID NO: 1015 - DNA, 21 bp, Artificial Sequence
  Description of Artificial Sequence: Synthetic oligonucleotide
  Description of Combined DNA/RNA Molecule: Synthetic oligonucleotide
gcuagcaacacccaaaggutt

SEQ ID NO: 1016 - DNA, 21 bp, Artificial Sequence
  Description of Artificial Sequence: Synthetic oligonucleotide
  Description of Combined DNA/RNA Molecule: Synthetic oligonucleotide
accuuuggguguugcuagctt

SEQ ID NO: 1017 - DNA, 21 bp, Artificial Sequence
  Description of Artificial Sequence: Synthetic oligonucleotide
  Description of Combined DNA/RNA Molecule: Synthetic oligonucleotide
ggagccaucaccuaggacutt

SEQ ID NO: 1018 - DNA, 21 bp, Artificial Sequence
  Description of Artificial Sequence: Synthetic oligonucleotide
  Description of Combined DNA/RNA Molecule: Synthetic oligonucleotide
aguccuaggugauggcucctt

SEQ ID NO: 1019 - DNA, 21 bp, Artificial Sequence
  Description of Artificial Sequence: Synthetic oligonucleotide
  Description of Combined DNA/RNA Molecule: Synthetic oligonucleotide
caccuaggacugacucggctt

SEQ ID NO: 1020 - DNA, 21 bp, Artificial Sequence
  Description of Artificial Sequence: Synthetic oligonucleotide
  Description of Combined DNA/RNA Molecule: Synthetic oligonucleotide
gccgagucaguccuaggugtt

SEQ ID NO: 1021 - DNA, 21 bp, Artificial Sequence
  Description of Artificial Sequence: Synthetic oligonucleotide
  Description of Combined DNA/RNA Molecule: Synthetic oligonucleotide
aggacugacucggcagugutt

SEQ ID NO: 1022 - DNA, 21 bp, Artificial Sequence
  Description of Artificial Sequence: Synthetic oligonucleotide
  Description of Combined DNA/RNA Molecule: Synthetic oligonucleotide
acacugccgagucaguccutt

SEQ ID NO: 1023 - DNA, 21 bp, Artificial Sequence
  Description of Artificial Sequence: Synthetic oligonucleotide
  Description of Combined DNA/RNA Molecule: Synthetic oligonucleotide
ggacugacucggcagugugtt

SEQ ID NO: 1024 - DNA, 21 bp, Artificial Sequence
  Description of Artificial Sequence: Synthetic oligonucleotide
  Description of Combined DNA/RNA Molecule: Synthetic oligonucleotide
cacacugccgagucagucctt

SEQ ID NO: 1025 - DNA, 21 bp, Artificial Sequence
  Description of Artificial Sequence: Synthetic oligonucleotide
  Description of Combined DNA/RNA Molecule: Synthetic oligonucleotide
uggugcaugcacugucucatt

SEQ ID NO: 1026 - DNA, 21 bp, Artificial Sequence
  Description of Artificial Sequence: Synthetic oligonucleotide
  Description of Combined DNA/RNA Molecule: Synthetic oligonucleotide
ugagacagugcaugcaccatt

SEQ ID NO: 1027 - DNA, 21 bp, Artificial Sequence
  Description of Artificial Sequence: Synthetic oligonucleotide
  Description of Combined DNA/RNA Molecule: Synthetic oligonucleotide
augcacugucucagccaactt

SEQ ID NO: 1028 - DNA, 21 bp, Artificial Sequence
  Description of Artificial Sequence: Synthetic oligonucleotide
  Description of Combined DNA/RNA Molecule: Synthetic oligonucleotide
guuggcugagacagugcautt

SEQ ID NO: 1029 - DNA, 21 bp, Artificial Sequence
  Description of Artificial Sequence: Synthetic oligonucleotide
  Description of Combined DNA/RNA Molecule: Synthetic oligonucleotide
cugucucagccaacccgcutt

SEQ ID NO: 1030 - DNA, 21 bp, Artificial Sequence
  Description of Artificial Sequence: Synthetic oligonucleotide
  Description of Combined DNA/RNA Molecule: Synthetic oligonucleotide
agcggguuggcugagacagtt

SEQ ID NO: 1031 - DNA, 21 bp, Artificial Sequence
  Description of Artificial Sequence: Synthetic oligonucleotide
  Description of Combined DNA/RNA Molecule: Synthetic oligonucleotide
cucagccaacccgcuccactt

SEQ ID NO: 1032 - DNA, 21 bp, Artificial Sequence
  Description of Artificial Sequence: Synthetic oligonucleotide
  Description of Combined DNA/RNA Molecule: Synthetic oligonucleotide
guggagcggguuggcugagtt

SEQ ID NO: 1033 - DNA, 21 bp, Artificial Sequence
  Description of Artificial Sequence: Synthetic oligonucleotide
  Description of Combined DNA/RNA Molecule: Synthetic oligonucleotide
cucagccaacccgcuccactt

SEQ ID NO: 1034 - DNA, 21 bp, Artificial Sequence
  Description of Artificial Sequence: Synthetic oligonucleotide
  Description of Combined DNA/RNA Molecule: Synthetic oligonucleotide
guggagcggguuggcugagtt

SEQ ID NO: 1035 - DNA, 21 bp, Artificial Sequence
  Description of Artificial Sequence: Synthetic oligonucleotide
  Description of Combined DNA/RNA Molecule: Synthetic oligonucleotide
gccaacccgcuccacuacctt

SEQ ID NO: 1036 - DNA, 21 bp, Artificial Sequence
  Description of Artificial Sequence: Synthetic oligonucleotide
  Description of Combined DNA/RNA Molecule: Synthetic oligonucleotide
gguaguggagcggguuggctt

SEQ ID NO: 1037 - DNA, 21 bp, Artificial Sequence
  Description of Artificial Sequence: Synthetic oligonucleotide
  Description of Combined DNA/RNA Molecule: Synthetic oligonucleotide
gccaacccgcuccacuacctt

SEQ ID NO: 1038 - DNA, 21 bp, Artificial Sequence
  Description of Artificial Sequence: Synthetic oligonucleotide
  Description of Combined DNA/RNA Molecule: Synthetic oligonucleotide
gguaguggagcggguuggctt

SEQ ID NO: 1039 - DNA, 21 bp, Artificial Sequence
  Description of Artificial Sequence: Synthetic oligonucleotide
  Description of Combined DNA/RNA Molecule: Synthetic oligonucleotide
aacccgcuccacuacccggtt

SEQ ID NO: 1040 - DNA, 21 bp, Artificial Sequence
  Description of Artificial Sequence: Synthetic oligonucleotide
  Description of Combined DNA/RNA Molecule: Synthetic oligonucleotide
ccggguaguggagcggguutt

SEQ ID NO: 1041 - DNA, 21 bp, Artificial Sequence
  Description of Artificial Sequence: Synthetic oligonucleotide
  Description of Combined DNA/RNA Molecule: Synthetic oligonucleotide
ccgcuccacuacccggcagtt

SEQ ID NO: 1042 - DNA, 21 bp, Artificial Sequence
  Description of Artificial Sequence: Synthetic oligonucleotide
  Description of Combined DNA/RNA Molecule: Synthetic oligonucleotide
cugccggguaguggagcggtt

SEQ ID NO: 1043 - DNA, 21 bp, Artificial Sequence
  Description of Artificial Sequence: Synthetic oligonucleotide
  Description of Combined DNA/RNA Molecule: Synthetic oligonucleotide
cuacccggcaggguacacatt

SEQ ID NO: 1044 - DNA, 21 bp, Artificial Sequence
  Description of Artificial Sequence: Synthetic oligonucleotide
  Description of Combined DNA/RNA Molecule: Synthetic oligonucleotide
uguguacccugccggguagtt

SEQ ID NO: 1045 - DNA, 21 bp, Artificial Sequence
  Description of Artificial Sequence: Synthetic oligonucleotide
  Description of Combined DNA/RNA Molecule: Synthetic oligonucleotide
uacccggcaggguacacautt

SEQ ID NO: 1046 - DNA, 21 bp, Artificial Sequence
  Description of Artificial Sequence: Synthetic oligonucleotide
  Description of Combined DNA/RNA Molecule: Synthetic oligonucleotide
auguguacccugccggguatt

SEQ ID NO: 1047 - DNA, 21 bp, Artificial Sequence
  Description of Artificial Sequence: Synthetic oligonucleotide
  Description of Combined DNA/RNA Molecule: Synthetic oligonucleotide
acccggcaggguacacauutt

SEQ ID NO: 1048 - DNA, 21 bp, Artificial Sequence
  Description of Artificial Sequence: Synthetic oligonucleotide
  Description of Combined DNA/RNA Molecule: Synthetic oligonucleotide
aauguguacccugccgggutt

SEQ ID NO: 1049 - DNA, 21 bp, Artificial Sequence
  Description of Artificial Sequence: Synthetic oligonucleotide
  Description of Combined DNA/RNA Molecule: Synthetic oligonucleotide
cccggcaggguacacauuctt

SEQ ID NO: 1050 - DNA, 21 bp, Artificial Sequence
  Description of Artificial Sequence: Synthetic oligonucleotide
  Description of Combined DNA/RNA Molecule: Synthetic oligonucleotide
gaauguguacccugccgggtt

SEQ ID NO: 1051 - DNA, 21 bp, Artificial Sequence
  Description of Artificial Sequence: Synthetic oligonucleotide
  Description of Combined DNA/RNA Molecule: Synthetic oligonucleotide
cggcaggguacacauucgctt

SEQ ID NO: 1052 - DNA, 21 bp, Artificial Sequence
  Description of Artificial Sequence: Synthetic oligonucleotide
  Description of Combined DNA/RNA Molecule: Synthetic oligonucleotide
gcgaauguguacccugccgtt

SEQ ID NO: 1053 - DNA, 21 bp, Artificial Sequence
  Description of Artificial Sequence: Synthetic oligonucleotide
  Description of Combined DNA/RNA Molecule: Synthetic oligonucleotide
gcaggguacacauucgcactt

SEQ ID NO: 1054 - DNA, 21 bp, Artificial Sequence
  Description of Artificial Sequence: Synthetic oligonucleotide
  Description of Combined DNA/RNA Molecule: Synthetic oligonucleotide
gugcgaauguguacccugctt

SEQ ID NO: 1055 - DNA, 21 bp, Artificial Sequence
  Description of Artificial Sequence: Synthetic oligonucleotide
  Description of Combined DNA/RNA Molecule: Synthetic oligonucleotide
caggguacacauucgcacctt

SEQ ID NO: 1056 - DNA, 21 bp, Artificial Sequence
  Description of Artificial Sequence: Synthetic oligonucleotide
  Description of Combined DNA/RNA Molecule: Synthetic oligonucleotide
ggugcgaauguguacccugtt

SEQ ID NO: 1057 - DNA, 21 bp, Artificial Sequence
  Description of Artificial Sequence: Synthetic oligonucleotide
  Description of Combined DNA/RNA Molecule: Synthetic oligonucleotide
aggguacacauucgcaccctt

SEQ ID NO: 1058 - DNA, 21 bp, Artificial Sequence
  Description of Artificial Sequence: Synthetic oligonucleotide
  Description of Combined DNA/RNA Molecule: Synthetic oligonucleotide
gggugcgaauguguacccutt

SEQ ID NO: 1059 - DNA, 21 bp, Artificial Sequence
  Description of Artificial Sequence: Synthetic oligonucleotide
  Description of Combined DNA/RNA Molecule: Synthetic oligonucleotide
ggaacugagccagaaacgctt

SEQ ID NO: 1060 - DNA, 21 bp, Artificial Sequence
  Description of Artificial Sequence: Synthetic oligonucleotide
  Description of Combined DNA/RNA Molecule: Synthetic oligonucleotide
gcguuucuggcucaguucctt

SEQ ID NO: 1061 - DNA, 21 bp, Artificial Sequence
  Description of Artificial Sequence: Synthetic oligonucleotide
  Description of Combined DNA/RNA Molecule: Synthetic oligonucleotide
gaacugagccagaaacgcatt

SEQ ID NO: 1062 - DNA, 21 bp, Artificial Sequence
  Description of Artificial Sequence: Synthetic oligonucleotide
  Description of Combined DNA/RNA Molecule: Synthetic oligonucleotide
ugcguuucuggcucaguuctt

SEQ ID NO: 1063 - DNA, 21 bp, Artificial Sequence
  Description of Artificial Sequence: Synthetic oligonucleotide
  Description of Combined DNA/RNA Molecule: Synthetic oligonucleotide
aacugagccagaaacgcagtt

SEQ ID NO: 1064 - DNA, 21 bp, Artificial Sequence
  Description of Artificial Sequence: Synthetic oligonucleotide
  Description of Combined DNA/RNA Molecule: Synthetic oligonucleotide
cugcguuucuggcucaguutt

SEQ ID NO: 1065 - DNA, 21 bp, Artificial Sequence
  Description of Artificial Sequence: Synthetic oligonucleotide
  Description of Combined DNA/RNA Molecule: Synthetic oligonucleotide
ugagccagaaacgcagauutt

SEQ ID NO: 1066 - DNA, 21 bp, Artificial Sequence
  Description of Artificial Sequence: Synthetic oligonucleotide
  Description of Combined DNA/RNA Molecule: Synthetic oligonucleotide
aaucugcguuucuggcucatt

SEQ ID NO: 1067 - DNA, 21 bp, Artificial Sequence
  Description of Artificial Sequence: Synthetic oligonucleotide
  Description of Combined DNA/RNA Molecule: Synthetic oligonucleotide
agaaacgcagauugggcugtt

SEQ ID NO: 1068 - DNA, 21 bp, Artificial Sequence
  Description of Artificial Sequence: Synthetic oligonucleotide
  Description of Combined DNA/RNA Molecule: Synthetic oligonucleotide
cagcccaaucugcguuucutt

SEQ ID NO: 1069 - DNA, 21 bp, Artificial Sequence
  Description of Artificial Sequence: Synthetic oligonucleotide
  Description of Combined DNA/RNA Molecule: Synthetic oligonucleotide
aacgcagauugggcuggcutt

SEQ ID NO: 1070 - DNA, 21 bp, Artificial Sequence
  Description of Artificial Sequence: Synthetic oligonucleotide
  Description of Combined DNA/RNA Molecule: Synthetic oligonucleotide
agccagcccaaucugcguutt

SEQ ID NO: 1071 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1072 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1073 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1074 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1075 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1076 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1077 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1078 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1079 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1080 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1081 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1082 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1083 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1084 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1085 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1086 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1087 - DNA, 21 bp, Artificial Sequence
  Description of Artificial Sequence: Synthetic oligonucleotide
  Description of Combined DNA/RNA Molecule: Synthetic oligonucleotide
agccaagccucuucuuacutt

SEQ ID NO: 1088 - DNA, 21 bp, Artificial Sequence
  Description of Artificial Sequence: Synthetic oligonucleotide
  Description of Combined DNA/RNA Molecule: Synthetic oligonucleotide
aguaagaagaggcuuggcutt

SEQ ID NO: 1089 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1090 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1091 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1092 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1093 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1094 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1095 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1096 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1097 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1098 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1099 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1100 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1101 - DNA, 21 bp, Artificial Sequence
  Description of Artificial Sequence: Synthetic oligonucleotide
  Description of Combined DNA/RNA Molecule: Synthetic oligonucleotide
ugguucccugaggaccagctt

SEQ ID NO: 1102 - DNA, 21 bp, Artificial Sequence
  Description of Artificial Sequence: Synthetic oligonucleotide
  Description of Combined DNA/RNA Molecule: Synthetic oligonucleotide
gcugguccucagggaaccatt

SEQ ID NO: 1103 - DNA, 21 bp, Artificial Sequence
  Description of Artificial Sequence: Synthetic oligonucleotide
  Description of Combined DNA/RNA Molecule: Synthetic oligonucleotide
ucuucuuacuucacccggctt

SEQ ID NO: 1104 - DNA, 21 bp, Artificial Sequence
  Description of Artificial Sequence: Synthetic oligonucleotide
  Description of Combined DNA/RNA Molecule: Synthetic oligonucleotide
gccgggugaaguaagaagatt

SEQ ID NO: 1105 - DNA, 21 bp, Artificial Sequence
  Description of Artificial Sequence: Synthetic oligonucleotide
  Description of Combined DNA/RNA Molecule: Synthetic oligonucleotide
cuucuuacuucacccggcutt

SEQ ID NO: 1106 - DNA, 21 bp, Artificial Sequence
  Description of Artificial Sequence: Synthetic oligonucleotide
  Description of Combined DNA/RNA Molecule: Synthetic oligonucleotide
agccgggugaaguaagaagtt

SEQ ID NO: 1107 - DNA, 21 bp, Artificial Sequence
  Description of Artificial Sequence: Synthetic oligonucleotide
  Description of Combined DNA/RNA Molecule: Synthetic oligonucleotide
uucuuacuucacccggcugtt

SEQ ID NO: 1108 - DNA, 21 bp, Artificial Sequence
  Description of Artificial Sequence: Synthetic oligonucleotide
  Description of Combined DNA/RNA Molecule: Synthetic oligonucleotide
cagccgggugaaguaagaatt

SEQ ID NO: 1109 - DNA, 21 bp, Artificial Sequence
  Description of Artificial Sequence: Synthetic oligonucleotide
  Description of Combined DNA/RNA Molecule: Synthetic oligonucleotide
gggcuccucauuuuuacggtt

SEQ ID NO: 1110 - DNA, 21 bp, Artificial Sequence
  Description of Artificial Sequence: Synthetic oligonucleotide
  Description of Combined DNA/RNA Molecule: Synthetic oligonucleotide
ccguaaaaaugaggagccctt

SEQ ID NO: 1111 - DNA, 21 bp, Artificial Sequence
  Description of Artificial Sequence: Synthetic oligonucleotide
  Description of Combined DNA/RNA Molecule: Synthetic oligonucleotide
ggcuccucauuuuuacgggtt

SEQ ID NO: 1112 - DNA, 21 bp, Artificial Sequence
  Description of Artificial Sequence: Synthetic oligonucleotide
  Description of Combined DNA/RNA Molecule: Synthetic oligonucleotide
cccguaaaaaugaggagcctt

SEQ ID NO: 1113 - DNA, 21 bp, Artificial Sequence
  Description of Artificial Sequence: Synthetic oligonucleotide
  Description of Combined DNA/RNA Molecule: Synthetic oligonucleotide
gcuccucauuuuuacgggutt

SEQ ID NO: 1114 - DNA, 21 bp, Artificial Sequence
  Description of Artificial Sequence: Synthetic oligonucleotide
  Description of Combined DNA/RNA Molecule: Synthetic oligonucleotide
acccguaaaaaugaggagctt

SEQ ID NO: 1115 - DNA, 21 bp, Artificial Sequence
  Description of Artificial Sequence: Synthetic oligonucleotide
  Description of Combined DNA/RNA Molecule: Synthetic oligonucleotide
cuccucauuuuuacggguatt

SEQ ID NO: 1116 - DNA, 21 bp, Artificial Sequence
  Description of Artificial Sequence: Synthetic oligonucleotide
  Description of Combined DNA/RNA Molecule: Synthetic oligonucleotide
uacccguaaaaaugaggagtt

SEQ ID NO: 1117 - DNA, 21 bp, Artificial Sequence
  Description of Artificial Sequence: Synthetic oligonucleotide
  Description of Combined DNA/RNA Molecule: Synthetic oligonucleotide
uccucauuuuuacggguaatt

SEQ ID NO: 1118 - DNA, 21 bp, Artificial Sequence
  Description of Artificial Sequence: Synthetic oligonucleotide
  Description of Combined DNA/RNA Molecule: Synthetic oligonucleotide
uuacccguaaaaaugaggatt

SEQ ID NO: 1119 - DNA, 21 bp, Artificial Sequence
  Description of Artificial Sequence: Synthetic oligonucleotide
  Description of Combined DNA/RNA Molecule: Synthetic oligonucleotide
ccucauuuuuacggguaactt

SEQ ID NO: 1120 - DNA, 21 bp, Artificial Sequence
  Description of Artificial Sequence: Synthetic oligonucleotide
  Description of Combined DNA/RNA Molecule: Synthetic oligonucleotide
guuacccguaaaaaugaggtt

SEQ ID NO: 1121 - DNA, 21 bp, Artificial Sequence
  Description of Artificial Sequence: Synthetic oligonucleotide
  Description of Combined DNA/RNA Molecule: Synthetic oligonucleotide
cucauuuuuacggguaacatt

SEQ ID NO: 1122 - DNA, 21 bp, Artificial Sequence
  Description of Artificial Sequence: Synthetic oligonucleotide
  Description of Combined DNA/RNA Molecule: Synthetic oligonucleotide
uguuacccguaaaaaugagtt

SEQ ID NO: 1123 - DNA, 21 bp, Artificial Sequence
  Description of Artificial Sequence: Synthetic oligonucleotide
  Description of Combined DNA/RNA Molecule: Synthetic oligonucleotide
cauuuuuacggguaacagutt

SEQ ID NO: 1124 - DNA, 21 bp, Artificial Sequence
  Description of Artificial Sequence: Synthetic oligonucleotide
  Description of Combined DNA/RNA Molecule: Synthetic oligonucleotide
acuguuacccguaaaaaugtt

SEQ ID NO: 1125 - DNA, 21 bp, Artificial Sequence
  Description of Artificial Sequence: Synthetic oligonucleotide
  Description of Combined DNA/RNA Molecule: Synthetic oligonucleotide
auuuuuacggguaacagugtt

SEQ ID NO: 1126 - DNA, 21 bp, Artificial Sequence
  Description of Artificial Sequence: Synthetic oligonucleotide
  Description of Combined DNA/RNA Molecule: Synthetic oligonucleotide
cacuguuacccguaaaaautt

SEQ ID NO: 1127 - DNA, 21 bp, Artificial Sequence
  Description of Artificial Sequence: Synthetic oligonucleotide
  Description of Combined DNA/RNA Molecule: Synthetic oligonucleotide
uuuacggguaacagugaggtt

SEQ ID NO: 1128 - DNA, 21 bp, Artificial Sequence
  Description of Artificial Sequence: Synthetic oligonucleotide
  Description of Combined DNA/RNA Molecule: Synthetic oligonucleotide
ccucacuguuacccguaaatt

SEQ ID NO: 1129 - DNA, 21 bp, Artificial Sequence
  Description of Artificial Sequence: Synthetic oligonucleotide
  Description of Combined DNA/RNA Molecule: Synthetic oligonucleotide
cagaccaggaagcucggugtt

SEQ ID NO: 1130 - DNA, 21 bp, Artificial Sequence
  Description of Artificial Sequence: Synthetic oligonucleotide
  Description of Combined DNA/RNA Molecule: Synthetic oligonucleotide
caccgagcuuccuggucugtt

SEQ ID NO: 1131 - DNA, 21 bp, Artificial Sequence
  Description of Artificial Sequence: Synthetic oligonucleotide
  Description of Combined DNA/RNA Molecule: Synthetic oligonucleotide
gaccaggaagcucggugagtt

SEQ ID NO: 1132 - DNA, 21 bp, Artificial Sequence
  Description of Artificial Sequence: Synthetic oligonucleotide
  Description of Combined DNA/RNA Molecule: Synthetic oligonucleotide
cucaccgagcuuccugguctt

SEQ ID NO: 1133 - DNA, 21 bp, Artificial Sequence
  Description of Artificial Sequence: Synthetic oligonucleotide
  Description of Combined DNA/RNA Molecule: Synthetic oligonucleotide
ccaggaagcucggugagugtt

SEQ ID NO: 1134 - DNA, 21 bp, Artificial Sequence
  Description of Artificial Sequence: Synthetic oligonucleotide
  Description of Combined DNA/RNA Molecule: Synthetic oligonucleotide
cacucaccgagcuuccuggtt

SEQ ID NO: 1135 - DNA, 21 bp, Artificial Sequence
  Description of Artificial Sequence: Synthetic oligonucleotide
  Description of Combined DNA/RNA Molecule: Synthetic oligonucleotide
ggaagcucggugagugaugtt

SEQ ID NO: 1136 - DNA, 21 bp, Artificial Sequence
  Description of Artificial Sequence: Synthetic oligonucleotide
  Description of Combined DNA/RNA Molecule: Synthetic oligonucleotide
caucacucaccgagcuucctt

SEQ ID NO: 1137 - DNA, 21 bp, Artificial Sequence
  Description of Artificial Sequence: Synthetic oligonucleotide
  Description of Combined DNA/RNA Molecule: Synthetic oligonucleotide
gugagugauggcagaacgatt

SEQ ID NO: 1138 - DNA, 21 bp, Artificial Sequence
  Description of Artificial Sequence: Synthetic oligonucleotide
  Description of Combined DNA/RNA Molecule: Synthetic oligonucleotide
ucguucugccaucacucactt

SEQ ID NO: 1139 - DNA, 21 bp, Artificial Sequence
  Description of Artificial Sequence: Synthetic oligonucleotide
  Description of Combined DNA/RNA Molecule: Synthetic oligonucleotide
gagugauggcagaacgaugtt

SEQ ID NO: 1140 - DNA, 21 bp, Artificial Sequence
  Description of Artificial Sequence: Synthetic oligonucleotide
  Description of Combined DNA/RNA Molecule: Synthetic oligonucleotide
caucguucugccaucacuctt

SEQ ID NO: 1141 - DNA, 21 bp, Artificial Sequence
  Description of Artificial Sequence: Synthetic oligonucleotide
  Description of Combined DNA/RNA Molecule: Synthetic oligonucleotide
gauggcagaacgaugccugtt

SEQ ID NO: 1142 - DNA, 21 bp, Artificial Sequence
  Description of Artificial Sequence: Synthetic oligonucleotide
  Description of Combined DNA/RNA Molecule: Synthetic oligonucleotide
caggcaucguucugccauctt

SEQ ID NO: 1143 - DNA, 21 bp, Artificial Sequence
  Description of Artificial Sequence: Synthetic oligonucleotide
  Description of Combined DNA/RNA Molecule: Synthetic oligonucleotide
agaacgaugccugcaggcatt

SEQ ID NO: 1144 - DNA, 21 bp, Artificial Sequence
  Description of Artificial Sequence: Synthetic oligonucleotide
  Description of Combined DNA/RNA Molecule: Synthetic oligonucleotide
ugccugcaggcaucguucutt

SEQ ID NO: 1145 - DNA, 21 bp, Artificial Sequence
  Description of Artificial Sequence: Synthetic oligonucleotide
  Description of Combined DNA/RNA Molecule: Synthetic oligonucleotide
acgaugccugcaggcauggtt

SEQ ID NO: 1146 - DNA, 21 bp, Artificial Sequence
  Description of Artificial Sequence: Synthetic oligonucleotide
  Description of Combined DNA/RNA Molecule: Synthetic oligonucleotide
ccaugccugcaggcaucgutt

SEQ ID NO: 1147 - DNA, 21 bp, Artificial Sequence
  Description of Artificial Sequence: Synthetic oligonucleotide
  Description of Combined DNA/RNA Molecule: Synthetic oligonucleotide
gcaggcauggaacuuuuuctt

SEQ ID NO: 1148 - DNA, 21 bp, Artificial Sequence
  Description of Artificial Sequence: Synthetic oligonucleotide
  Description of Combined DNA/RNA Molecule: Synthetic oligonucleotide
gaaaaaguuccaugccugctt

SEQ ID NO: 1149 - DNA, 21 bp, Artificial Sequence
  Description of Artificial Sequence: Synthetic oligonucleotide
  Description of Combined DNA/RNA Molecule: Synthetic oligonucleotide
ggaacuuuuuccguuaucatt

SEQ ID NO: 1150 - DNA, 21 bp, Artificial Sequence
  Description of Artificial Sequence: Synthetic oligonucleotide
  Description of Combined DNA/RNA Molecule: Synthetic oligonucleotide
ugauaacggaaaaaguucctt

SEQ ID NO: 1151 - DNA, 21 bp, Artificial Sequence
  Description of Artificial Sequence: Synthetic oligonucleotide
  Description of Combined DNA/RNA Molecule: Synthetic oligonucleotide
gaacuuuuuccguuaucactt

SEQ ID NO: 1152 - DNA, 21 bp, Artificial Sequence
  Description of Artificial Sequence: Synthetic oligonucleotide
  Description of Combined DNA/RNA Molecule: Synthetic oligonucleotide
gugauaacggaaaaaguuctt

SEQ ID NO: 1153 - DNA, 21 bp, Artificial Sequence
  Description of Artificial Sequence: Synthetic oligonucleotide
  Description of Combined DNA/RNA Molecule: Synthetic oligonucleotide
aacuuuuuccguuaucacctt

SEQ ID NO: 1154 - DNA, 21 bp, Artificial Sequence
  Description of Artificial Sequence: Synthetic oligonucleotide
  Description of Combined DNA/RNA Molecule: Synthetic oligonucleotide
ggugauaacggaaaaaguutt

SEQ ID NO: 1155 - DNA, 21 bp, Artificial Sequence
  Description of Artificial Sequence: Synthetic oligonucleotide
  Description of Combined DNA/RNA Molecule: Synthetic oligonucleotide
uaucacccaggccugauuctt

SEQ ID NO: 1156 - DNA, 21 bp, Artificial Sequence
  Description of Artificial Sequence: Synthetic oligonucleotide
  Description of Combined DNA/RNA Molecule: Synthetic oligonucleotide
gaaucaggccugggugauatt

SEQ ID NO: 1157 - DNA, 21 bp, Artificial Sequence
  Description of Artificial Sequence: Synthetic oligonucleotide
  Description of Combined DNA/RNA Molecule: Synthetic oligonucleotide
aggccugauucacuggccutt

SEQ ID NO: 1158 - DNA, 21 bp, Artificial Sequence
  Description of Artificial Sequence: Synthetic oligonucleotide
  Description of Combined DNA/RNA Molecule: Synthetic oligonucleotide
aggccagugaaucaggccutt

SEQ ID NO: 1159 - DNA, 21 bp, Artificial Sequence
  Description of Artificial Sequence: Synthetic oligonucleotide
  Description of Combined DNA/RNA Molecule: Synthetic oligonucleotide
ugauucacuggccuggcggtt

SEQ ID NO: 1160 - DNA, 21 bp, Artificial Sequence
  Description of Artificial Sequence: Synthetic oligonucleotide
  Description of Combined DNA/RNA Molecule: Synthetic oligonucleotide
ccgccaggccagugaaucatt

SEQ ID NO: 1161 - DNA, 21 bp, Artificial Sequence
  Description of Artificial Sequence: Synthetic oligonucleotide
  Description of Combined DNA/RNA Molecule: Synthetic oligonucleotide
auucacuggccuggcggagtt

SEQ ID NO: 1162 - DNA, 21 bp, Artificial Sequence
  Description of Artificial Sequence: Synthetic oligonucleotide
  Description of Combined DNA/RNA Molecule: Synthetic oligonucleotide
cuccgccaggccagugaautt

SEQ ID NO: 1163 - DNA, 21 bp, Artificial Sequence
  Description of Artificial Sequence: Synthetic oligonucleotide
  Description of Combined DNA/RNA Molecule: Synthetic oligonucleotide
gcuucuaaggcauggucggtt

SEQ ID NO: 1164 - DNA, 21 bp, Artificial Sequence
  Description of Artificial Sequence: Synthetic oligonucleotide
  Description of Combined DNA/RNA Molecule: Synthetic oligonucleotide
ccgaccaugccuuagaagctt

SEQ ID NO: 1165 - DNA, 21 bp, Artificial Sequence
  Description of Artificial Sequence: Synthetic oligonucleotide
  Description of Combined DNA/RNA Molecule: Synthetic oligonucleotide
cuucuaaggcauggucgggtt

SEQ ID NO: 1166 - DNA, 21 bp, Artificial Sequence
  Description of Artificial Sequence: Synthetic oligonucleotide
  Description of Combined DNA/RNA Molecule: Synthetic oligonucleotide
cccgaccaugccuuagaagtt

SEQ ID NO: 1167 - DNA, 21 bp, Artificial Sequence
  Description of Artificial Sequence: Synthetic oligonucleotide
  Description of Combined DNA/RNA Molecule: Synthetic oligonucleotide
gagggccaacaacuguccctt

SEQ ID NO: 1168 - DNA, 21 bp, Artificial Sequence
  Description of Artificial Sequence: Synthetic oligonucleotide
  Description of Combined DNA/RNA Molecule: Synthetic oligonucleotide
gggacaguuguuggcccuctt

SEQ ID NO: 1169 - DNA, 21 bp, Artificial Sequence
  Description of Artificial Sequence: Synthetic oligonucleotide
  Description of Combined DNA/RNA Molecule: Synthetic oligonucleotide
acugucccuccuugagcactt

SEQ ID NO: 1170 - DNA, 21 bp, Artificial Sequence
  Description of Artificial Sequence: Synthetic oligonucleotide
  Description of Combined DNA/RNA Molecule: Synthetic oligonucleotide
gugcucaaggagggacagutt

SEQ ID NO: 1171 - DNA, 21 bp, Artificial Sequence
  Description of Artificial Sequence: Synthetic oligonucleotide
  Description of Combined DNA/RNA Molecule: Synthetic oligonucleotide
acugucccuccuugagcactt

SEQ ID NO: 1172 - DNA, 21 bp, Artificial Sequence
  Description of Artificial Sequence: Synthetic oligonucleotide
  Description of Combined DNA/RNA Molecule: Synthetic oligonucleotide
gugcucaaggagggacagutt

SEQ ID NO: 1173 - DNA, 21 bp, Artificial Sequence
  Description of Artificial Sequence: Synthetic oligonucleotide
  Description of Combined DNA/RNA Molecule: Synthetic oligonucleotide
cugucccuccuugagcacctt

SEQ ID NO: 1174 - DNA, 21 bp, Artificial Sequence
  Description of Artificial Sequence: Synthetic oligonucleotide
  Description of Combined DNA/RNA Molecule: Synthetic oligonucleotide
ggugcucaaggagggacagtt

SEQ ID NO: 1175 - DNA, 21 bp, Artificial Sequence
  Description of Artificial Sequence: Synthetic oligonucleotide
  Description of Combined DNA/RNA Molecule: Synthetic oligonucleotide
cugucccuccuugagcacctt

SEQ ID NO: 1176 - DNA, 21 bp, Artificial Sequence
  Description of Artificial Sequence: Synthetic oligonucleotide
  Description of Combined DNA/RNA Molecule: Synthetic oligonucleotide
ggugcucaaggagggacagtt

SEQ ID NO: 1177 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1178 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1179 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1180 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1181 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1182 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1183 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1184 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1185 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1186 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1187 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1188 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1189 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1190 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1191 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1192 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1193 - DNA, 21 bp, Artificial Sequence
  Description of Artificial Sequence: Synthetic oligonucleotide
  Description of Combined DNA/RNA Molecule: Synthetic oligonucleotide
acauuuaucuuuugggucutt

SEQ ID NO: 1194 - DNA, 21 bp, Artificial Sequence
  Description of Artificial Sequence: Synthetic oligonucleotide
  Description of Combined DNA/RNA Molecule: Synthetic oligonucleotide
agacccaaaagauaaaugutt

SEQ ID NO: 1195 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1196 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 1197 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1198 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 1199 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1200 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 1201 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1202 - DNA, 21 bp, Artificial Sequence
  Description of Artificial Sequence: Synthetic oligonucleotide
  Description of Combined DNA/RNA Molecule: Synthetic oligonucleotide
ggcuccggcagcagauggctt

SEQ ID NO: 1203 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1204 - DNA, 21 bp, Artificial Sequence
  Description of Artificial Sequence: Synthetic oligonucleotide
  Description of Combined DNA/RNA Molecule: Synthetic oligonucleotide
ggcucaugcagcagauggctt

SEQ ID NO: 1205 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1206 - DNA, 21 bp, Artificial Sequence
  Description of Artificial Sequence: Synthetic oligonucleotide
  Description of Combined DNA/RNA Molecule: Synthetic oligonucleotide
ggcucaugcagcagauggctt

SEQ ID NO: 1207 - DNA, 21 bp, Artificial Sequence
  Description of Artificial Sequence: Synthetic oligonucleotide
  Description of Combined DNA/RNA Molecule: Synthetic oligonucleotide
gccaucugcugccggagcctt

SEQ ID NO: 1208 - DNA, 21 bp, Artificial Sequence
  Description of Artificial Sequence: Synthetic oligonucleotide
  Description of Combined DNA/RNA Molecule: Synthetic oligonucleotide
ggcucaugcagcagauggctt

SEQ ID NO: 1209 - DNA, 21 bp, Artificial Sequence
  Description of Artificial Sequence: Synthetic oligonucleotide
  Description of Combined DNA/RNA Molecule: Synthetic oligonucleotide
cauuuaucuuuugggucugtt

SEQ ID NO: 1210 - DNA, 21 bp, Artificial Sequence
  Description of Artificial Sequence: Synthetic oligonucleotide
  Description of Combined DNA/RNA Molecule: Synthetic oligonucleotide
cagacccaaaagauaaaugtt

SEQ ID NO: 1211 - DNA, 21 bp, Artificial Sequence
  Description of Artificial Sequence: Synthetic oligonucleotide
  Description of Combined DNA/RNA Molecule: Synthetic oligonucleotide
cauuuaucuuuugggucugtt

SEQ ID NO: 1212 - DNA, 21 bp, Artificial Sequence
  Description of Artificial Sequence: Synthetic oligonucleotide
  Description of Combined DNA/RNA Molecule: Synthetic oligonucleotide
cagacccaaaagauaaaugtt

SEQ ID NO: 1213 - DNA, 21 bp, Artificial Sequence
  Description of Artificial Sequence: Synthetic oligonucleotide
  Description of Combined DNA/RNA Molecule: Synthetic oligonucleotide
uaucuuuugggucuguccutt

SEQ ID NO: 1214 - DNA, 21 bp, Artificial Sequence
  Description of Artificial Sequence: Synthetic oligonucleotide
  Description of Combined DNA/RNA Molecule: Synthetic oligonucleotide
aggacagacccaaaagauatt

SEQ ID NO: 1215 - DNA, 21 bp, Artificial Sequence
  Description of Artificial Sequence: Synthetic oligonucleotide
  Description of Combined DNA/RNA Molecule: Synthetic oligonucleotide
uaucuuuugggucuguccutt

SEQ ID NO: 1216 - DNA, 21 bp, Artificial Sequence
  Description of Artificial Sequence: Synthetic oligonucleotide
  Description of Combined DNA/RNA Molecule: Synthetic oligonucleotide
aggacagacccaaaagauatt

SEQ ID NO: 1217 - DNA, 21 bp, Artificial Sequence
  Description of Artificial Sequence: Synthetic oligonucleotide
  Description of Combined DNA/RNA Molecule: Synthetic oligonucleotide
cucuguugccuuuuuacagtt

SEQ ID NO: 1218 - DNA, 21 bp, Artificial Sequence
  Description of Artificial Sequence: Synthetic oligonucleotide
  Description of Combined DNA/RNA Molecule: Synthetic oligonucleotide
cuguaaaaaggcaacagagtt

SEQ ID NO: 1219 - DNA, 21 bp, Artificial Sequence
  Description of Artificial Sequence: Synthetic oligonucleotide
  Description of Combined DNA/RNA Molecule: Synthetic oligonucleotide
cucuguugccuuuuuacagtt

SEQ ID NO: 1220 - DNA, 21 bp, Artificial Sequence
  Description of Artificial Sequence: Synthetic oligonucleotide
  Description of Combined DNA/RNA Molecule: Synthetic oligonucleotide
cuguaaaaaggcaacagagtt

SEQ ID NO: 1221 - DNA, 21 bp, Artificial Sequence
  Description of Artificial Sequence: Synthetic oligonucleotide
  Description of Combined DNA/RNA Molecule: Synthetic oligonucleotide
ccuuuuuacagccaacuuutt

SEQ ID NO: 1222 - DNA, 21 bp, Artificial Sequence
  Description of Artificial Sequence: Synthetic oligonucleotide
  Description of Combined DNA/RNA Molecule: Synthetic oligonucleotide
aaaguuggcuguaaaaaggtt

SEQ ID NO: 1223 - DNA, 21 bp, Artificial Sequence
  Description of Artificial Sequence: Synthetic oligonucleotide
  Description of Combined DNA/RNA Molecule: Synthetic oligonucleotide
agccaacuuuucuagaccutt

SEQ ID NO: 1224 - DNA, 21 bp, Artificial Sequence
  Description of Artificial Sequence: Synthetic oligonucleotide
  Description of Combined DNA/RNA Molecule: Synthetic oligonucleotide
aggucuagaaaaguuggcutt

SEQ ID NO: 1225 - DNA, 21 bp, Artificial Sequence
  Description of Artificial Sequence: Synthetic oligonucleotide
  Description of Combined DNA/RNA Molecule: Synthetic oligonucleotide
acuuuucuagaccuguuuutt

SEQ ID NO: 1226 - DNA, 21 bp, Artificial Sequence
  Description of Artificial Sequence: Synthetic oligonucleotide
  Description of Combined DNA/RNA Molecule: Synthetic oligonucleotide
aaaacaggucuagaaaagutt

SEQ ID NO: 1227 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1228 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1229 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1230 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1231 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1232 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1233 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1234 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1235 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1236 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1237 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1238 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1239 - DNA, 20 bp, Artificial Sequence
  Description of Artificial Sequence: Synthetic oligonucleotide
  Description of Combined DNA/RNA Molecule: Synthetic oligonucleotide
uucuagaccuguuuucuutt

SEQ ID NO: 1240 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1241 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1242 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1243 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1244 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1245 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1246 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1247 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1248 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1249 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1250 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1251 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1252 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1253 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1254 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1255 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1256 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1257 - DNA, 21 bp, Artificial Sequence
  Description of Artificial Sequence: Synthetic oligonucleotide
  Description of Combined DNA/RNA Molecule: Synthetic oligonucleotide
cauaggccuggaguuuauutt

SEQ ID NO: 1258 - DNA, 21 bp, Artificial Sequence
  Description of Artificial Sequence: Synthetic oligonucleotide
  Description of Combined DNA/RNA Molecule: Synthetic oligonucleotide
aauaaacuccaggccuaugtt

SEQ ID NO: 1259 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1260 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1261 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1262 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1263 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1264 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1265 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1266 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1267 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1268 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1269 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1270 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1271 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1272 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1273 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1274 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1275 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1276 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1277 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1278 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1279 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1280 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1281 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1282 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1283 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1284 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1285 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1286 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1287 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1288 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1289 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1290 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1291 - DNA, 21 bp, Artificial Sequence
  Description of Artificial Sequence: Synthetic oligonucleotide
  Description of Combined DNA/RNA Molecule: Synthetic oligonucleotide
ugaagauauuuauucugggtt

SEQ ID NO: 1292 - DNA, 21 bp, Artificial Sequence
  Description of Artificial Sequence: Synthetic oligonucleotide
  Description of Combined DNA/RNA Molecule: Synthetic oligonucleotide
cccagaauaaauaucuucatt

SEQ ID NO: 1293 - DNA, 21 bp, Artificial Sequence
  Description of Artificial Sequence: Synthetic oligonucleotide
  Description of Combined DNA/RNA Molecule: Synthetic oligonucleotide
ugaagauauuuauucugggtt

SEQ ID NO: 1294 - DNA, 21 bp, Artificial Sequence
  Description of Artificial Sequence: Synthetic oligonucleotide
  Description of Combined DNA/RNA Molecule: Synthetic oligonucleotide
cccagaauaaauaucuucatt

SEQ ID NO: 1295 - DNA, 21 bp, Artificial Sequence
  Description of Artificial Sequence: Synthetic oligonucleotide
  Description of Combined DNA/RNA Molecule: Synthetic oligonucleotide
ucuggguuuuguagcauuutt

SEQ ID NO: 1296 - DNA, 21 bp, Artificial Sequence
  Description of Artificial Sequence: Synthetic oligonucleotide
  Description of Combined DNA/RNA Molecule: Synthetic oligonucleotide
aaaugcuacaaaacccagatt

SEQ ID NO: 1297 - DNA, 21 bp, Artificial Sequence
  Description of Artificial Sequence: Synthetic oligonucleotide
  Description of Combined DNA/RNA Molecule: Synthetic oligonucleotide
ucuggguuuuguagcauuutt

SEQ ID NO: 1298 - DNA, 21 bp, Artificial Sequence
  Description of Artificial Sequence: Synthetic oligonucleotide
  Description of Combined DNA/RNA Molecule: Synthetic oligonucleotide
aaaugcuacaaaacccagatt

SEQ ID NO: 1299 - DNA, 21 bp, Artificial Sequence
  Description of Artificial Sequence: Synthetic oligonucleotide
  Description of Combined DNA/RNA Molecule: Synthetic oligonucleotide
auaaaaacaaacaaacguutt

SEQ ID NO: 1300 - DNA, 21 bp, Artificial Sequence
  Description of Artificial Sequence: Synthetic oligonucleotide
  Description of Combined DNA/RNA Molecule: Synthetic oligonucleotide
aacguuuguuuguuuuuautt

SEQ ID NO: 1301 - DNA, 21 bp, Artificial Sequence
  Description of Artificial Sequence: Synthetic oligonucleotide
  Description of Combined DNA/RNA Molecule: Synthetic oligonucleotide
aaacaaacaaacguugucctt

SEQ ID NO: 1302 - DNA, 21 bp, Artificial Sequence
  Description of Artificial Sequence: Synthetic oligonucleotide
  Description of Combined DNA/RNA Molecule: Synthetic oligonucleotide
ggacaacguuuguuuguuutt

SEQ ID NO: 1303 - DNA, 21 bp, Artificial Sequence
  Description of Artificial Sequence: Synthetic oligonucleotide
  Description of Combined DNA/RNA Molecule: Synthetic oligonucleotide
aacaaacaaacguuguccutt

SEQ ID NO: 1304 - DNA, 21 bp, Artificial Sequence
  Description of Artificial Sequence: Synthetic oligonucleotide
  Description of Combined DNA/RNA Molecule: Synthetic oligonucleotide
aggacaacguuuguuuguutt

SEQ ID NO: 1305 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1306 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1307 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1308 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1309 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1310 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1311 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1312 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1313 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1314 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1315 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1316 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1317 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1318 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1319 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1320 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1321 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1322 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1323 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1324 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1325 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1326 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1327 - RNA, 19 nt, Artificial Sequence
  Description of Artificial Sequence: Synthetic oligonucleotide
gccuggaguuuauucggaa

SEQ ID NO: 1328 - RNA, 21 nt, Artificial Sequence
  Description of Artificial Sequence: Synthetic oligonucleotide
uuccgaauaaacuccaggccu

SEQ ID NO: 1329 - RNA, 20 nt, Artificial Sequence
  Description of Artificial Sequence: Synthetic oligonucleotide
gccuggaguuuauucggaaa

SEQ ID NO: 1330 - RNA, 22 nt, Artificial Sequence
  Description of Artificial Sequence: Synthetic oligonucleotide
uuuccgaauaaacuccaggccu

SEQ ID NO: 1331 - RNA, 21 nt, Artificial Sequence
  Description of Artificial Sequence: Synthetic oligonucleotide
gccuggaguuuauucggaaaa

SEQ ID NO: 1332 - RNA, 23 nt, Artificial Sequence
  Description of Artificial Sequence: Synthetic oligonucleotide
uuuuccgaauaaacuccaggccu

SEQ ID NO: 1333 - RNA, 22 nt, Artificial Sequence
  Description of Artificial Sequence: Synthetic oligonucleotide
gccuggaguuuauucggaaaag

SEQ ID NO: 1334 - RNA, 24 nt, Artificial Sequence
  Description of Artificial Sequence: Synthetic oligonucleotide
cuuuuccgaauaaacuccaggccu

SEQ ID NO: 1335 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1336 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1337 - DNA, 23 bp, Artificial Sequence
  Description of Artificial Sequence: Synthetic oligonucleotide
  Description of Combined DNA/RNA Molecule: Synthetic oligonucleotide
  modified_base (23)..(23): Abasic nucleotide
gccuggaguuuauucggaaattn

SEQ ID NO: 1338 - DNA, 23 bp, Artificial Sequence
  Description of Artificial Sequence: Synthetic oligonucleotide
  Description of Combined DNA/RNA Molecule: Synthetic oligonucleotide
  modified_base (23)..(23): Abasic nucleotide
uuuccgaauaaacuccaggcttn

SEQ ID NO: 1339 - DNA, 24 bp, Artificial Sequence
  Description of Artificial Sequence: Synthetic oligonucleotide
  Description of Combined DNA/RNA Molecule: Synthetic oligonucleotide
  modified_base (24)..(24): Abasic nucleotide
gccuggaguuuauucggaaaattn

SEQ ID NO: 1340 - DNA, 24 bp, Artificial Sequence
  Description of Artificial Sequence: Synthetic oligonucleotide
  Description of Combined DNA/RNA Molecule: Synthetic oligonucleotide
  modified_base (24)..(24): Abasic nucleotide
uuuuccgaauaaacuccaggcttn

SEQ ID NO: 1341 - DNA, 25 bp, Artificial Sequence
  Description of Artificial Sequence: Synthetic oligonucleotide
  Description of Combined DNA/RNA Molecule: Synthetic oligonucleotide
  modified_base (25)..(25): Abasic nucleotide
gccuggaguuuauucggaaaagttn

SEQ ID NO: 1342 - DNA, 25 bp, Artificial Sequence
  Description of Artificial Sequence: Synthetic oligonucleotide
  Description of Combined DNA/RNA Molecule: Synthetic oligonucleotide
  modified_base (25)..(25): Abasic nucleotide
cuuuuccgaauaaacuccaggcttn

SEQ ID NO: 1343 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1344 - RNA, 21 nt, Artificial Sequence
  Description of Artificial Sequence: Synthetic oligonucleotide
uuccgaauaaacuccaggccu

SEQ ID NO: 1345 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1346 - RNA, 21 nt, Artificial Sequence
  Description of Artificial Sequence: Synthetic oligonucleotide
uuccgaauaaacuccaggccu

SEQ ID NO: 1347 - RNA, 19 nt, Artificial Sequence
  Description of Artificial Sequence: Synthetic oligonucleotide
gccuggaguuuauucggaa

SEQ ID NO: 1348 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1349 - RNA, 19 nt, Artificial Sequence
  Description of Artificial Sequence: Synthetic oligonucleotide
gccuggaguuuauucggaa

SEQ ID NO: 1350 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1351 - RNA, 19 nt, Artificial Sequence
  Description of Artificial Sequence: Synthetic oligonucleotide
gccuggaguuuauucggaa

SEQ ID NO: 1352 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1353 - RNA, 19 nt, Artificial Sequence
  Description of Artificial Sequence: Synthetic oligonucleotide
gccuggaguuuauucggaa

SEQ ID NO: 1354 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1355 - RNA, 19 nt, Artificial Sequence
  Description of Artificial Sequence: Synthetic oligonucleotide
gccuggaguuuauucggaa

SEQ ID NO: 1356 - RNA, 19 nt, Artificial Sequence
  Description of Artificial Sequence: Synthetic oligonucleotide
uuccgaauaaacuccaggc

SEQ ID NO: 1357 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, g, u, t, unknown or other
gccuggnaguuuauucggaatt

SEQ ID NO: 1358 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1359 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1360 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1361 - RNA, 19 nt, Artificial Sequence
  Description of Artificial Sequence: Synthetic oligonucleotide
gccuggaguuuauucggaa

SEQ ID NO: 1362 - RNA, 21 nt, Artificial Sequence
  Description of Artificial Sequence: Synthetic oligonucleotide
uuccgaauaaacuccaggccu

SEQ ID NO: 1363 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, g, u, t, unknown or other
gccuggnaguuuauucggaatt

SEQ ID NO: 1364 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1365 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1366 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1367 - RNA, 19 nt, Artificial Sequence
  Description of Artificial Sequence: Synthetic oligonucleotide
gccuggaguuuauucggaa

SEQ ID NO: 1368 - RNA, 21 nt, Artificial Sequence
  Description of Artificial Sequence: Synthetic oligonucleotide
uuccgaauaaacuccaggccu

SEQ ID NO: 1369 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, g, u, t, unknown or other
gccuggnaguuuauucggaatt

SEQ ID NO: 1370 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1371 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1372 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1373 - RNA, 19 nt, Artificial Sequence
  Description of Artificial Sequence: Synthetic oligonucleotide
gccuggaguuuauucggaa

SEQ ID NO: 1374 - RNA, 21 nt, Artificial Sequence
  Description of Artificial Sequence: Synthetic oligonucleotide
uuccgaauaaacuccaggccu

SEQ ID NO: 1375 - RNA, 19 nt, Artificial Sequence
  Description of Artificial Sequence: Synthetic oligonucleotide
gccuggaguuuauucggaa

SEQ ID NO: 1376 - RNA, 19 nt, Artificial Sequence
  Description of Artificial Sequence: Synthetic oligonucleotide
uuccgaauaaacuccaggc

SEQ ID NO: 1377 - RNA, 19 nt, Artificial Sequence
  Description of Artificial Sequence: Synthetic oligonucleotide
gccuggaguuuauucggaa

SEQ ID NO: 1378 - RNA, 19 nt, Artificial Sequence
  Description of Artificial Sequence: Synthetic oligonucleotide
uuccgaauaaacuccaggc

SEQ ID NO: 1379 - RNA, 19 nt, Artificial Sequence
  Description of Artificial Sequence: Synthetic oligonucleotide
gccuggaguuuauucggaa

SEQ ID NO: 1380 - RNA, 19 nt, Artificial Sequence
  Description of Artificial Sequence: Synthetic oligonucleotide
uuccgaauaaacuccaggc

SEQ ID NO: 1381 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1382 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1383 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1384 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1385 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1386 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1387 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1388 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1389 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1390 - RNA, 21 nt, Artificial Sequence
  Description of Artificial Sequence: Synthetic oligonucleotide
uuccgaauaaacuccaggccu

SEQ ID NO: 1391 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1392 - RNA, 21 nt, Artificial Sequence
  Description of Artificial Sequence: Synthetic oligonucleotide
uuccgaauaaacuccaggccu

SEQ ID NO: 1393 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1394 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1395 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1396 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1397 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, t, g, u, unknown or other
gccuggnaguuuauucggaatt

SEQ ID NO: 1398 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1399 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
gccuggaguuuauucggaattn

SEQ ID NO: 1400 - DNA, 22 bp, Artificial Sequence
  Description of Artificial Sequence: Synthetic oligonucleotide
  Description of Combined DNA/RNA Molecule: Synthetic oligonucleotide
  modified_base (22)..(22): Abasic nucleotide
uuccgaauaaacuccaggcttn

SEQ ID NO: 1401 - RNA, 19 nt, Artificial Sequence
  Description of Artificial Sequence: Synthetic oligonucleotide
gccuggaguuuauucggaa

SEQ ID NO: 1402 - RNA, 21 nt, Artificial Sequence
  Description of Artificial Sequence: Synthetic oligonucleotide
uuccgaauaaacuccaggccu

SEQ ID NO: 1403 - RNA, 19 nt, Artificial Sequence
  Description of Artificial Sequence: Synthetic oligonucleotide
gccuggaguuuauucggaa

SEQ ID NO: 1404 - RNA, 21 nt, Artificial Sequence
  Description of Artificial Sequence: Synthetic oligonucleotide
uuccgaauaaacuccaggccu

SEQ ID NO: 1405 - RNA, 19 nt, Artificial Sequence
  Description of Artificial Sequence: Synthetic oligonucleotide
gccuggaguuuauucggaa

SEQ ID NO: 1406 - RNA, 21 nt, Artificial Sequence
  Description of Artificial Sequence: Synthetic oligonucleotide
uuccgaauaaacuccaggccu

SEQ ID NO: 1407 - RNA, 19 nt, Artificial Sequence
  Description of Artificial Sequence: Synthetic oligonucleotide
gccuggaguuuauucggaa

SEQ ID NO: 1408 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1409 - RNA, 19 nt, Artificial Sequence
  Description of Artificial Sequence: Synthetic oligonucleotide
gccuggaguuuauucggaa

SEQ ID NO: 1410 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1411 - RNA, 19 nt, Artificial Sequence
  Description of Artificial Sequence: Synthetic oligonucleotide
gccuggaguuuauucggaa

SEQ ID NO: 1412 - RNA, 19 nt, Artificial Sequence
  Description of Artificial Sequence: Synthetic oligonucleotide
uuccgaauaaacuccaggc

SEQ ID NO: 1413 - RNA, 19 nt, Artificial Sequence
  Description of Artificial Sequence: Synthetic oligonucleotide
gccuggaguuuauucggaa

SEQ ID NO: 1414 - RNA, 19 nt, Artificial Sequence
  Description of Artificial Sequence: Synthetic oligonucleotide
uuccgaauaaacuccaggc

SEQ ID NO: 1415 - RNA, 19 nt, Artificial Sequence
  Description of Artificial Sequence: Synthetic oligonucleotide
gccuggaguuuauucggaa

SEQ ID NO: 1416 - RNA, 21 nt, Artificial Sequence
  Description of Artificial Sequence: Synthetic oligonucleotide
uuccgaauaaacuccaggccu

SEQ ID NO: 1417 - RNA, 19 nt, Artificial Sequence
  Description of Artificial Sequence: Synthetic oligonucleotide
gccuggaguuuauucggaa

SEQ ID NO: 1418 - RNA, 21 nt, Artificial Sequence
  Description of Artificial Sequence: Synthetic oligonucleotide
uuccgaauaaacuccaggccu

SEQ ID NO: 1419 - RNA, 19 nt, Artificial Sequence
  Description of Artificial Sequence: Synthetic oligonucleotide
gccuggaguuuauucggaa

SEQ ID NO: 1420 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1421 - RNA, 19 nt, Artificial Sequence
  Description of Artificial Sequence: Synthetic oligonucleotide
gccuggaguuuauucggaa

SEQ ID NO: 1422 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1423 - RNA, 19 nt, Artificial Sequence
  Description of Artificial Sequence: Synthetic oligonucleotide
gccuggaguuuauucggaa

SEQ ID NO: 1424 - RNA, 21 nt, Artificial Sequence
  Description of Artificial Sequence: Synthetic oligonucleotide
uuccgaauaaacuccaggccu

SEQ ID NO: 1425 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1426 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1427 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1428 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1429 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1430 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1431 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1432 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1433 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1434 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1435 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1436 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1437 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1438 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1439 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1440 - RNA, 21 nt, Artificial Sequence
  Description of Artificial Sequence: Synthetic oligonucleotide
uuccgaauaaacuccaggccu

SEQ ID NO: 1441 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1442 - RNA, 21 nt, Artificial Sequence
  Description of Artificial Sequence: Synthetic oligonucleotide
uuccgaauaaacuccaggccu

SEQ ID NO: 1443 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1444 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1445 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1446 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1447 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1448 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1449 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1450 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1451 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1452 - RNA, 21 nt, Artificial Sequence
  Description of Artificial Sequence: Synthetic oligonucleotide
uuccgaauaaacuccaggccu

SEQ ID NO: 1453 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1454 - RNA, 21 nt, Artificial Sequence
  Description of Artificial Sequence: Synthetic oligonucleotide
uuccgaauaaacuccaggccu

SEQ ID NO: 1455 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1456 - RNA, 21 nt, Artificial Sequence
  Description of Artificial Sequence: Synthetic oligonucleotide
uuccgaauaaacuccaggccu

SEQ ID NO: 1457 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1458 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1459 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1460 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1461 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1462 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1463 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1464 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1465 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, t, g, u, unknown or other
gccuggnaguuuauucggaatt

SEQ ID NO: 1466 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1467 - RNA, 19 nt, Artificial Sequence
  Description of Artificial Sequence: Synthetic oligonucleotide
gccuggaguuuauucggaa

SEQ ID NO: 1468 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1469 - RNA, 20 nt, Artificial Sequence
  Description of Artificial Sequence: Synthetic oligonucleotide
gccuggagguuuauucggaa

SEQ ID NO: 1470 - RNA, 21 nt, Artificial Sequence
  Description of Artificial Sequence: Synthetic oligonucleotide
uuccgaauaaacuccaggccu

SEQ ID NO: 1471 - RNA, 20 nt, Artificial Sequence
  Description of Artificial Sequence: Synthetic oligonucleotide
gccuggagguuuauucggaa

SEQ ID NO: 1472 - RNA, 19 nt, Artificial Sequence
  Description of Artificial Sequence: Synthetic oligonucleotide
uuccgaauaaacuccaggc

SEQ ID NO: 1473 - RNA, 20 nt, Artificial Sequence
  Description of Artificial Sequence: Synthetic oligonucleotide
gccuggagguuuauucggaa

SEQ ID NO: 1474 - RNA, 21 nt, Artificial Sequence
  Description of Artificial Sequence: Synthetic oligonucleotide
uuccgaauaaacuccaggccu

SEQ ID NO: 1475 - RNA, 20 nt, Artificial Sequence
  Description of Artificial Sequence: Synthetic oligonucleotide
gccuggagguuuauucggaa

SEQ ID NO: 1476 - RNA, 21 nt, Artificial Sequence
  Description of Artificial Sequence: Synthetic oligonucleotide
uuccgaauaaacuccaggccu

SEQ ID NO: 1477 - RNA, 20 nt, Artificial Sequence
  Description of Artificial Sequence: Synthetic oligonucleotide
gccuggagguuuauucggaa

SEQ ID NO: 1478 - RNA, 19 nt, Artificial Sequence
  Description of Artificial Sequence: Synthetic oligonucleotide
uuccgaauaaacuccaggc

SEQ ID NO: 1479 - RNA, 20 nt, Artificial Sequence
  Description of Artificial Sequence: Synthetic oligonucleotide
gccuggagguuuauucggaa

SEQ ID NO: 1480 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1481 - RNA, 20 nt, Artificial Sequence
  Description of Artificial Sequence: Synthetic oligonucleotide
gccuggagguuuauucggaa

SEQ ID NO: 1482 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1483 - RNA, 20 nt, Artificial Sequence
  Description of Artificial Sequence: Synthetic oligonucleotide
gccuggagguuuauucggaa

SEQ ID NO: 1484 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1485 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1486 - RNA, 21 nt, Artificial Sequence
  Description of Artificial Sequence: Synthetic oligonucleotide
uuccgaauaaacuccaggccu

SEQ ID NO: 1487 - RNA, 19 nt, Artificial Sequence
  Description of Artificial Sequence: Synthetic oligonucleotide
gccuggaguuuauucggaa

SEQ ID NO: 1488 - RNA, 21 nt, Artificial Sequence
  Description of Artificial Sequence: Synthetic oligonucleotide
uuccgaauaaacuccaggccu

SEQ ID NO: 1489 - RNA, 19 nt, Artificial Sequence
  Description of Artificial Sequence: Synthetic oligonucleotide
gccuggaguuuauucggaa

SEQ ID NO: 1490 - RNA, 21 nt, Artificial Sequence
  Description of Artificial Sequence: Synthetic oligonucleotide
uuccgaauaaacuccaggccu

SEQ ID NO: 1491 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1492 - RNA, 21 nt, Artificial Sequence
  Description of Artificial Sequence: Synthetic oligonucleotide
uuccgaauaaacuccaggccu

SEQ ID NO: 1493 - DNA, 22 bp, Artificial Sequence
  Description of Artificial Sequence: Synthetic oligonucleotide
  Description of Combined DNA/RNA Molecule: Synthetic oligonucleotide
  modified_base (7)..(7): a, c, t, g, u, unknown or other
gccuggnaguuuauucggaatt

SEQ ID NO: 1494 - RNA, 21 nt, Artificial Sequence
  Description of Artificial Sequence: Synthetic oligonucleotide
uuccgaauaaacuccaggccu

SEQ ID NO: 1495 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1496 - RNA, 21 nt, Artificial Sequence
  Description of Artificial Sequence: Synthetic oligonucleotide
uuccgaauaaacuccaggccu

SEQ ID NO: 1497 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1498 - RNA, 21 nt, Artificial Sequence
  Description of Artificial Sequence: Synthetic oligonucleotide
uuccgaauaaacuccaggccu

SEQ ID NO: 1499 - RNA, 19 nt, Artificial Sequence
  Description of Artificial Sequence: Synthetic oligonucleotide
gccuggaguuuauucggaa

SEQ ID NO: 1500 - RNA, 21 nt, Artificial Sequence
  Description of Artificial Sequence: Synthetic oligonucleotide
uuccgaauaaacuccaggccu

SEQ ID NO: 1501 - RNA, 20 nt, Artificial Sequence
  Description of Artificial Sequence: Synthetic oligonucleotide
gccuggagguuuauucggaa

SEQ ID NO: 1502 - RNA, 21 nt, Artificial Sequence
  Description of Artificial Sequence: Synthetic oligonucleotide
uuccgaauaaacuccaggccu

SEQ ID NO: 1503 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 1504 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1505-1524 - skipped (20 entries)

SEQ ID NO: 1525 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1526 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1527 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1528 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1529 - DNA, 21 bp, Artificial Sequence
  Description of Artificial Sequence: Synthetic oligonucleotide
  Description of Combined DNA/RNA Molecule: Synthetic oligonucleotide
ucauaggccuggaguuuautt

SEQ ID NO: 1530 - DNA, 21 bp, Artificial Sequence
  Description of Artificial Sequence: Synthetic oligonucleotide
  Description of Combined DNA/RNA Molecule: Synthetic oligonucleotide
auaaacuccaggccuaugatt

SEQ ID NO: 1531 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1532 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1533-1534 - skipped (2 entries)

SEQ ID NO: 1535 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1536 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1537 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1538 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1539 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1540 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1541 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): Difluorotoluyl ribo(or deoxyribo)nucleotide
uucuagacnuguuuugcuutt

SEQ ID NO: 1542 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1543 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): Difluorotoluyl ribo(or deoxyribo)nucleotide
uucuagacnuguuuugcuutt

SEQ ID NO: 1544 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1545 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): Difluorotoluyl ribo(or deoxyribo)nucleotide
uucuagaccnguuuugcuutt

SEQ ID NO: 1546 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1547 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): Difluorotoluyl ribo(or deoxyribo)nucleotide
uucuagaccnguuuugcuutt

SEQ ID NO: 1548 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1549 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): Difluorotoluyl ribo(or deoxyribo)nucleotide
uucuagaccunuuuugcuutt

SEQ ID NO: 1550 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1551 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): Difluorotoluyl ribo(or deoxyribo)nucleotide
uucuagaccunuuuugcuutt

SEQ ID NO: 1552 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1553 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1554 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1555 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1556 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1557 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1558 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1559 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 1560 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1561 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): Difluorotoluyl ribo(or deoxyribo)nucleotide
uucuagacnuguuuugcuutt

SEQ ID NO: 1562 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1563 - DNA, 21 bp, Artificial Sequence
  Description of Artificial Sequence: Synthetic oligonucleotide
  Description of Combined DNA/RNA Molecule: Synthetic oligonucleotide
  modified_base (9)..(9): Difluorotoluyl ribo(or deoxyribo)nucleotide
uucuagacnuguuuugcuutt

SEQ ID NO: 1564 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1565 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): Difluorotoluyl ribo(or deoxyribo)nucleotide
uucuagaccnguuuugcuutt

SEQ ID NO: 1566 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1567 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): Difluorotoluyl ribo(or deoxyribo)nucleotide
uucuagaccnguuuugcuutt

SEQ ID NO: 1568 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1569 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): Difluorotoluyl ribo(or deoxyribo)nucleotide
uucuagaccunuuuugcuutt

SEQ ID NO: 1570 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1571 - DNA, 21 bp, Artificial Sequence
  Description of Artificial Sequence: Synthetic oligonucleotide
  Description of Combined DNA/RNA Molecule: Synthetic oligonucleotide
  modified_base (11)..(11): Difluorotoluyl ribo(or deoxyribo)nucleotide
uucuagaccunuuuugcuutt

SEQ ID NO: 1572 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 1573 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): Difluorotoluyl ribo(or deoxyribo)nucleotide
gccuggagunuauucggaatt

SEQ ID NO: 1574 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1575 - DNA, 21 bp, Artificial Sequence
  Description of Artificial Sequence: Synthetic oligonucleotide
  Description of Combined DNA/RNA Molecule: Synthetic oligonucleotide
  modified_base (10)..(10): Difluorotoluyl ribo(or deoxyribo)nucleotide
gccuggagunuauucggaatt

SEQ ID NO: 1576 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 1577 - DNA, 21 bp, Artificial Sequence
  Description of Artificial Sequence: Synthetic oligonucleotide
  Description of Combined DNA/RNA Molecule: Synthetic oligonucleotide
cagccaacuuuucuagacctt

SEQ ID NO: 1578 - DNA, 21 bp, Artificial Sequence
  Description of Artificial Sequence: Synthetic oligonucleotide
  Description of Combined DNA/RNA Molecule: Synthetic oligonucleotide
ggucuagaaaaguuggcugtt

SEQ ID NO: 1579 - DNA, 21 bp, Artificial Sequence
  Description of Artificial Sequence: Synthetic oligonucleotide
  Description of Combined DNA/RNA Molecule: Synthetic oligonucleotide
agccaacuuuucuagaccutt

SEQ ID NO: 1580 - DNA, 21 bp, Artificial Sequence
  Description of Artificial Sequence: Synthetic oligonucleotide
  Description of Combined DNA/RNA Molecule: Synthetic oligonucleotide
aggucuagaaaaguuggcutt

SEQ ID NO: 1581 - DNA, 21 bp, Artificial Sequence
  Description of Artificial Sequence: Synthetic oligonucleotide
  Description of Combined DNA/RNA Molecule: Synthetic oligonucleotide
gccaacuuuucuagaccugtt

SEQ ID NO: 1582 - DNA, 21 bp, Artificial Sequence
  Description of Artificial Sequence: Synthetic oligonucleotide
  Description of Combined DNA/RNA Molecule: Synthetic oligonucleotide
caggucuagaaaaguuggctt

SEQ ID NO: 1583 - DNA, 21 bp, Artificial Sequence
  Description of Artificial Sequence: Synthetic oligonucleotide
  Description of Combined DNA/RNA Molecule: Synthetic oligonucleotide
ccaacuuuucuagaccugutt

SEQ ID NO: 1584 - DNA, 21 bp, Artificial Sequence
  Description of Artificial Sequence: Synthetic oligonucleotide
  Description of Combined DNA/RNA Molecule: Synthetic oligonucleotide
acaggucuagaaaaguuggtt

SEQ ID NO: 1585 - DNA, 21 bp, Artificial Sequence
  Description of Artificial Sequence: Synthetic oligonucleotide
  Description of Combined DNA/RNA Molecule: Synthetic oligonucleotide
caacuuuucuagaccuguutt

SEQ ID NO: 1586 - DNA, 21 bp, Artificial Sequence
  Description of Artificial Sequence: Synthetic oligonucleotide
  Description of Combined DNA/RNA Molecule: Synthetic oligonucleotide
aacaggucuagaaaaguugtt

SEQ ID NO: 1587 - DNA, 21 bp, Artificial Sequence
  Description of Artificial Sequence: Synthetic oligonucleotide
  Description of Combined DNA/RNA Molecule: Synthetic oligonucleotide
aacuuuucuagaccuguuutt

SEQ ID NO: 1588 - DNA, 21 bp, Artificial Sequence
  Description of Artificial Sequence: Synthetic oligonucleotide
  Description of Combined DNA/RNA Molecule: Synthetic oligonucleotide
aaacaggucuagaaaaguutt

SEQ ID NO: 1589 - DNA, 21 bp, Artificial Sequence
  Description of Artificial Sequence: Synthetic oligonucleotide
  Description of Combined DNA/RNA Molecule: Synthetic oligonucleotide
acuuuucuagaccuguuuutt

SEQ ID NO: 1590 - DNA, 21 bp, Artificial Sequence
  Description of Artificial Sequence: Synthetic oligonucleotide
  Description of Combined DNA/RNA Molecule: Synthetic oligonucleotide
aaaacaggucuagaaaagutt

SEQ ID NO: 1591 - DNA, 21 bp, Artificial Sequence
  Description of Artificial Sequence: Synthetic oligonucleotide
  Description of Combined DNA/RNA Molecule: Synthetic oligonucleotide
cuuuucuagaccuguuuugtt

SEQ ID NO: 1592 - DNA, 21 bp, Artificial Sequence
  Description of Artificial Sequence: Synthetic oligonucleotide
  Description of Combined DNA/RNA Molecule: Synthetic oligonucleotide
caaaacaggucuagaaaagtt

SEQ ID NO: 1593 - DNA, 21 bp, Artificial Sequence
  Description of Artificial Sequence: Synthetic oligonucleotide
  Description of Combined DNA/RNA Molecule: Synthetic oligonucleotide
uuuucuagaccuguuuugctt

SEQ ID NO: 1594 - DNA, 21 bp, Artificial Sequence
  Description of Artificial Sequence: Synthetic oligonucleotide
  Description of Combined DNA/RNA Molecule: Synthetic oligonucleotide
gcaaaacaggucuagaaaatt

SEQ ID NO: 1595 - DNA, 21 bp, Artificial Sequence
  Description of Artificial Sequence: Synthetic oligonucleotide
  Description of Combined DNA/RNA Molecule: Synthetic oligonucleotide
uuucuagaccuguuuugcutt

SEQ ID NO: 1596 - DNA, 21 bp, Artificial Sequence
  Description of Artificial Sequence: Synthetic oligonucleotide
  Description of Combined DNA/RNA Molecule: Synthetic oligonucleotide
agcaaaacaggucuagaaatt

SEQ ID NO: 1597 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1598 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1599 - DNA, 21 bp, Artificial Sequence
  Description of Artificial Sequence: Synthetic oligonucleotide
  Description of Combined DNA/RNA Molecule: Synthetic oligonucleotide
cuagaccuguuuugcuuuutt

SEQ ID NO: 1600 - DNA, 21 bp, Artificial Sequence
  Description of Artificial Sequence: Synthetic oligonucleotide
  Description of Combined DNA/RNA Molecule: Synthetic oligonucleotide
aaaagcaaaacaggucuagtt

SEQ ID NO: 1601 - DNA, 21 bp, Artificial Sequence
  Description of Artificial Sequence: Synthetic oligonucleotide
  Description of Combined DNA/RNA Molecule: Synthetic oligonucleotide
uagaccuguuuugcuuuugtt

SEQ ID NO: 1602 - DNA, 21 bp, Artificial Sequence
  Description of Artificial Sequence: Synthetic oligonucleotide
  Description of Combined DNA/RNA Molecule: Synthetic oligonucleotide
caaaagcaaaacaggucuatt

SEQ ID NO: 1603 - DNA, 21 bp, Artificial Sequence
  Description of Artificial Sequence: Synthetic oligonucleotide
  Description of Combined DNA/RNA Molecule: Synthetic oligonucleotide
agaccuguuuugcuuuugutt

SEQ ID NO: 1604 - DNA, 21 bp, Artificial Sequence
  Description of Artificial Sequence: Synthetic oligonucleotide
  Description of Combined DNA/RNA Molecule: Synthetic oligonucleotide
acaaaagcaaaacaggucutt

SEQ ID NO: 1605 - DNA, 21 bp, Artificial Sequence
  Description of Artificial Sequence: Synthetic oligonucleotide
  Description of Combined DNA/RNA Molecule: Synthetic oligonucleotide
gaccuguuuugcuuuuguatt

SEQ ID NO: 1606 - DNA, 21 bp, Artificial Sequence
  Description of Artificial Sequence: Synthetic oligonucleotide
  Description of Combined DNA/RNA Molecule: Synthetic oligonucleotide
uacaaaagcaaaacagguctt

SEQ ID NO: 1607 - DNA, 21 bp, Artificial Sequence
  Description of Artificial Sequence: Synthetic oligonucleotide
  Description of Combined DNA/RNA Molecule: Synthetic oligonucleotide
accuguuuugcuuuuguaatt

SEQ ID NO: 1608 - DNA, 21 bp, Artificial Sequence
  Description of Artificial Sequence: Synthetic oligonucleotide
  Description of Combined DNA/RNA Molecule: Synthetic oligonucleotide
uuacaaaagcaaaacaggutt

SEQ ID NO: 1609 - DNA, 21 bp, Artificial Sequence
  Description of Artificial Sequence: Synthetic oligonucleotide
  Description of Combined DNA/RNA Molecule: Synthetic oligonucleotide
ccuguuuugcuuuuguaactt

SEQ ID NO: 1610 - DNA, 21 bp, Artificial Sequence
  Description of Artificial Sequence: Synthetic oligonucleotide
  Description of Combined DNA/RNA Molecule: Synthetic oligonucleotide
guuacaaaagcaaaacaggtt

SEQ ID NO: 1611 - DNA, 21 bp, Artificial Sequence
  Description of Artificial Sequence: Synthetic oligonucleotide
  Description of Combined DNA/RNA Molecule: Synthetic oligonucleotide
cuguuuugcuuuuguaacutt

SEQ ID NO: 1612 - DNA, 21 bp, Artificial Sequence
  Description of Artificial Sequence: Synthetic oligonucleotide
  Description of Combined DNA/RNA Molecule: Synthetic oligonucleotide
aguuacaaaagcaaaacagtt

SEQ ID NO: 1613 - DNA, 21 bp, Artificial Sequence
  Description of Artificial Sequence: Synthetic oligonucleotide
  Description of Combined DNA/RNA Molecule: Synthetic oligonucleotide
uguuuugcuuuuguaacuutt

SEQ ID NO: 1614 - DNA, 21 bp, Artificial Sequence
  Description of Artificial Sequence: Synthetic oligonucleotide
  Description of Combined DNA/RNA Molecule: Synthetic oligonucleotide
aaguuacaaaagcaaaacatt

SEQ ID NO: 1615 - DNA, 21 bp, Artificial Sequence
  Description of Artificial Sequence: Synthetic oligonucleotide
  Description of Combined DNA/RNA Molecule: Synthetic oligonucleotide
guuuugcuuuuguaacuugtt

SEQ ID NO: 1616 - DNA, 21 bp, Artificial Sequence
  Description of Artificial Sequence: Synthetic oligonucleotide
  Description of Combined DNA/RNA Molecule: Synthetic oligonucleotide
caaguuacaaaagcaaaactt

SEQ ID NO: 1617 - DNA, 21 bp, Artificial Sequence
  Description of Artificial Sequence: Synthetic oligonucleotide
  Description of Combined DNA/RNA Molecule: Synthetic oligonucleotide
uuuugcuuuuguaacuugatt

SEQ ID NO: 1618 - DNA, 21 bp, Artificial Sequence
  Description of Artificial Sequence: Synthetic oligonucleotide
  Description of Combined DNA/RNA Molecule: Synthetic oligonucleotide
ucaaguuacaaaagcaaaatt

SEQ ID NO: 1619 - DNA, 21 bp, Artificial Sequence
  Description of Artificial Sequence: Synthetic oligonucleotide
  Description of Combined DNA/RNA Molecule: Synthetic oligonucleotide
uuugcuuuuguaacuugaatt

SEQ ID NO: 1620 - DNA, 21 bp, Artificial Sequence
  Description of Artificial Sequence: Synthetic oligonucleotide
  Description of Combined DNA/RNA Molecule: Synthetic oligonucleotide
uucaaguuacaaaagcaaatt

SEQ ID NO: 1621 - DNA, 21 bp, Artificial Sequence
  Description of Artificial Sequence: Synthetic oligonucleotide
  Description of Combined DNA/RNA Molecule: Synthetic oligonucleotide
uugcuuuuguaacuugaagtt

SEQ ID NO: 1622 - DNA, 21 bp, Artificial Sequence
  Description of Artificial Sequence: Synthetic oligonucleotide
  Description of Combined DNA/RNA Molecule: Synthetic oligonucleotide
cuucaaguuacaaaagcaatt

SEQ ID NO: 1623 - DNA, 21 bp, Artificial Sequence
  Description of Artificial Sequence: Synthetic oligonucleotide
  Description of Combined DNA/RNA Molecule: Synthetic oligonucleotide
ugcuuuuguaacuugaagatt

SEQ ID NO: 1624 - DNA, 21 bp, Artificial Sequence
  Description of Artificial Sequence: Synthetic oligonucleotide
  Description of Combined DNA/RNA Molecule: Synthetic oligonucleotide
ucuucaaguuacaaaagcatt

SEQ ID NO: 1625 - DNA, 21 bp, Artificial Sequence
  Description of Artificial Sequence: Synthetic oligonucleotide
  Description of Combined DNA/RNA Molecule: Synthetic oligonucleotide
gcuuuuguaacuugaagautt

SEQ ID NO: 1626 - DNA, 21 bp, Artificial Sequence
  Description of Artificial Sequence: Synthetic oligonucleotide
  Description of Combined DNA/RNA Molecule: Synthetic oligonucleotide
aucuucaaguuacaaaagctt

SEQ ID NO: 1627 - DNA, 21 bp, Artificial Sequence
  Description of Artificial Sequence: Synthetic oligonucleotide
  Description of Combined DNA/RNA Molecule: Synthetic oligonucleotide
cuuuuguaacuugaagauatt

SEQ ID NO: 1628 - DNA, 21 bp, Artificial Sequence
  Description of Artificial Sequence: Synthetic oligonucleotide
  Description of Combined DNA/RNA Molecule: Synthetic oligonucleotide
uaucuucaaguuacaaaagtt

SEQ ID NO: 1629 - DNA, 21 bp, Artificial Sequence
  Description of Artificial Sequence: Synthetic oligonucleotide
  Description of Combined DNA/RNA Molecule: Synthetic oligonucleotide
uuuuguaacuugaagauautt

SEQ ID NO: 1630 - DNA, 21 bp, Artificial Sequence
  Description of Artificial Sequence: Synthetic oligonucleotide
  Description of Combined DNA/RNA Molecule: Synthetic oligonucleotide
auaucuucaaguuacaaaatt

SEQ ID NO: 1631 - DNA, 21 bp, Artificial Sequence
  Description of Artificial Sequence: Synthetic oligonucleotide
  Description of Combined DNA/RNA Molecule: Synthetic oligonucleotide
uuuguaacuugaagauauutt

SEQ ID NO: 1632 - DNA, 21 bp, Artificial Sequence
  Description of Artificial Sequence: Synthetic oligonucleotide
  Description of Combined DNA/RNA Molecule: Synthetic oligonucleotide
aauaucuucaaguuacaaatt

SEQ ID NO: 1633 - DNA, 21 bp, Artificial Sequence
  Description of Artificial Sequence: Synthetic oligonucleotide
  Description of Combined DNA/RNA Molecule: Synthetic oligonucleotide
uuguaacuugaagauauuutt

SEQ ID NO: 1634 - DNA, 21 bp, Artificial Sequence
  Description of Artificial Sequence: Synthetic oligonucleotide
  Description of Combined DNA/RNA Molecule: Synthetic oligonucleotide
aaauaucuucaaguuacaatt

SEQ ID NO: 1635 - DNA, 21 bp, Artificial Sequence
  Description of Artificial Sequence: Synthetic oligonucleotide
  Description of Combined DNA/RNA Molecule: Synthetic oligonucleotide
uguaacuugaagauauuuatt

SEQ ID NO: 1636 - DNA, 21 bp, Artificial Sequence
  Description of Artificial Sequence: Synthetic oligonucleotide
  Description of Combined DNA/RNA Molecule: Synthetic oligonucleotide
uaaauaucuucaaguuacatt

SEQ ID NO: 1637 - DNA, 21 bp, Artificial Sequence
  Description of Artificial Sequence: Synthetic oligonucleotide
  Description of Combined DNA/RNA Molecule: Synthetic oligonucleotide
guaacuugaagauauuuautt

SEQ ID NO: 1638 - DNA, 21 bp, Artificial Sequence
  Description of Artificial Sequence: Synthetic oligonucleotide
  Description of Combined DNA/RNA Molecule: Synthetic oligonucleotide
auaaauaucuucaaguuactt

SEQ ID NO: 1639 - DNA, 21 bp, Artificial Sequence
  Description of Artificial Sequence: Synthetic oligonucleotide
  Description of Combined DNA/RNA Molecule: Synthetic oligonucleotide
uaacuugaagauauuuauutt

SEQ ID NO: 1640 - DNA, 21 bp, Artificial Sequence
  Description of Artificial Sequence: Synthetic oligonucleotide
  Description of Combined DNA/RNA Molecule: Synthetic oligonucleotide
aauaaauaucuucaaguuatt

SEQ ID NO: 1641 - DNA, 21 bp, Artificial Sequence
  Description of Artificial Sequence: Synthetic oligonucleotide
  Description of Combined DNA/RNA Molecule: Synthetic oligonucleotide
aacuugaagauauuuauuctt

SEQ ID NO: 1642 - DNA, 21 bp, Artificial Sequence
  Description of Artificial Sequence: Synthetic oligonucleotide
  Description of Combined DNA/RNA Molecule: Synthetic oligonucleotide
gaauaaauaucuucaaguutt

SEQ ID NO: 1643 - DNA, 21 bp, Artificial Sequence
  Description of Artificial Sequence: Synthetic oligonucleotide
  Description of Combined DNA/RNA Molecule: Synthetic oligonucleotide
acuugaagauauuuauucutt

SEQ ID NO: 1644 - DNA, 21 bp, Artificial Sequence
  Description of Artificial Sequence: Synthetic oligonucleotide
  Description of Combined DNA/RNA Molecule: Synthetic oligonucleotide
agaauaaauaucuucaagutt

SEQ ID NO: 1645 - DNA, 21 bp, Artificial Sequence
  Description of Artificial Sequence: Synthetic oligonucleotide
  Description of Combined DNA/RNA Molecule: Synthetic oligonucleotide
cuugaagauauuuauucugtt

SEQ ID NO: 1646 - DNA, 21 bp, Artificial Sequence
  Description of Artificial Sequence: Synthetic oligonucleotide
  Description of Combined DNA/RNA Molecule: Synthetic oligonucleotide
cagaauaaauaucuucaagtt

SEQ ID NO: 1647 - DNA, 21 bp, Artificial Sequence
  Description of Artificial Sequence: Synthetic oligonucleotide
  Description of Combined DNA/RNA Molecule: Synthetic oligonucleotide
uugaagauauuuauucuggtt

SEQ ID NO: 1648 - DNA, 21 bp, Artificial Sequence
  Description of Artificial Sequence: Synthetic oligonucleotide
  Description of Combined DNA/RNA Molecule: Synthetic oligonucleotide
ccagaauaaauaucuucaatt

SEQ ID NO: 1649 - DNA, 21 bp, Artificial Sequence
  Description of Artificial Sequence: Synthetic oligonucleotide
  Description of Combined DNA/RNA Molecule: Synthetic oligonucleotide
ugaagauauuuauucugggtt

SEQ ID NO: 1650 - DNA, 21 bp, Artificial Sequence
  Description of Artificial Sequence: Synthetic oligonucleotide
  Description of Combined DNA/RNA Molecule: Synthetic oligonucleotide
cccagaauaaauaucuucatt

SEQ ID NO: 1651 - DNA, 21 bp, Artificial Sequence
  Description of Artificial Sequence: Synthetic oligonucleotide
  Description of Combined DNA/RNA Molecule: Synthetic oligonucleotide
gaagauauuuauucugggutt

SEQ ID NO: 1652 - DNA, 21 bp, Artificial Sequence
  Description of Artificial Sequence: Synthetic oligonucleotide
  Description of Combined DNA/RNA Molecule: Synthetic oligonucleotide
acccagaauaaauaucuuctt

SEQ ID NO: 1653 - DNA, 21 bp, Artificial Sequence
  Description of Artificial Sequence: Synthetic oligonucleotide
  Description of Combined DNA/RNA Molecule: Synthetic oligonucleotide
cagccaacuuuucuagacctt

SEQ ID NO: 1654 - DNA, 21 bp, Artificial Sequence
  Description of Artificial Sequence: Synthetic oligonucleotide
  Description of Combined DNA/RNA Molecule: Synthetic oligonucleotide
ggucuagaaaaguuggcugtt

SEQ ID NO: 1655 - DNA, 21 bp, Artificial Sequence
  Description of Artificial Sequence: Synthetic oligonucleotide
  Description of Combined DNA/RNA Molecule: Synthetic oligonucleotide
agccaacuuuucuagaccutt

SEQ ID NO: 1656 - DNA, 21 bp, Artificial Sequence
  Description of Artificial Sequence: Synthetic oligonucleotide
  Description of Combined DNA/RNA Molecule: Synthetic oligonucleotide
aggucuagaaaaguuggcutt

SEQ ID NO: 1657 - DNA, 21 bp, Artificial Sequence
  Description of Artificial Sequence: Synthetic oligonucleotide
  Description of Combined DNA/RNA Molecule: Synthetic oligonucleotide
gccaacuuuucuagaccugtt

SEQ ID NO: 1658 - DNA, 21 bp, Artificial Sequence
  Description of Artificial Sequence: Synthetic oligonucleotide
  Description of Combined DNA/RNA Molecule: Synthetic oligonucleotide
caggucuagaaaaguuggctt

SEQ ID NO: 1659 - DNA, 21 bp, Artificial Sequence
  Description of Artificial Sequence: Synthetic oligonucleotide
  Description of Combined DNA/RNA Molecule: Synthetic oligonucleotide
ccaacuuuucuagaccugutt

SEQ ID NO: 1660 - DNA, 21 bp, Artificial Sequence
  Description of Artificial Sequence: Synthetic oligonucleotide
  Description of Combined DNA/RNA Molecule: Synthetic oligonucleotide
acaggucuagaaaaguuggtt

SEQ ID NO: 1661 - DNA, 21 bp, Artificial Sequence
  Description of Artificial Sequence: Synthetic oligonucleotide
  Description of Combined DNA/RNA Molecule: Synthetic oligonucleotide
caacuuuucuagaccuguutt

SEQ ID NO: 1662 - DNA, 21 bp, Artificial Sequence
  Description of Artificial Sequence: Synthetic oligonucleotide
  Description of Combined DNA/RNA Molecule: Synthetic oligonucleotide
aacaggucuagaaaaguugtt

SEQ ID NO: 1663 - DNA, 21 bp, Artificial Sequence
  Description of Artificial Sequence: Synthetic oligonucleotide
  Description of Combined DNA/RNA Molecule: Synthetic oligonucleotide
aacuuuucuagaccuguuutt

SEQ ID NO: 1664 - DNA, 21 bp, Artificial Sequence
  Description of Artificial Sequence: Synthetic oligonucleotide
  Description of Combined DNA/RNA Molecule: Synthetic oligonucleotide
aaacaggucuagaaaaguutt

SEQ ID NO: 1665 - DNA, 21 bp, Artificial Sequence
  Description of Artificial Sequence: Synthetic oligonucleotide
  Description of Combined DNA/RNA Molecule: Synthetic oligonucleotide
acuuuucuagaccuguuuutt

SEQ ID NO: 1666 - DNA, 21 bp, Artificial Sequence
  Description of Artificial Sequence: Synthetic oligonucleotide
  Description of Combined DNA/RNA Molecule: Synthetic oligonucleotide
aaaacaggucuagaaaagutt

SEQ ID NO: 1667 - DNA, 21 bp, Artificial Sequence
  Description of Artificial Sequence: Synthetic oligonucleotide
  Description of Combined DNA/RNA Molecule: Synthetic oligonucleotide
cuuuucuagaccuguuuugtt

SEQ ID NO: 1668 - DNA, 21 bp, Artificial Sequence
  Description of Artificial Sequence: Synthetic oligonucleotide
  Description of Combined DNA/RNA Molecule: Synthetic oligonucleotide
caaaacaggucuagaaaagtt

SEQ ID NO: 1669 - DNA, 21 bp, Artificial Sequence
  Description of Artificial Sequence: Synthetic oligonucleotide
  Description of Combined DNA/RNA Molecule: Synthetic oligonucleotide
uuuucuagaccuguuuugctt

SEQ ID NO: 1670 - DNA, 21 bp, Artificial Sequence
  Description of Artificial Sequence: Synthetic oligonucleotide
  Description of Combined DNA/RNA Molecule: Synthetic oligonucleotide
gcaaaacaggucuagaaaatt

SEQ ID NO: 1671 - DNA, 21 bp, Artificial Sequence
  Description of Artificial Sequence: Synthetic oligonucleotide
  Description of Combined DNA/RNA Molecule: Synthetic oligonucleotide
uuucuagaccuguuuugcutt

SEQ ID NO: 1672 - DNA, 21 bp, Artificial Sequence
  Description of Artificial Sequence: Synthetic oligonucleotide
  Description of Combined DNA/RNA Molecule: Synthetic oligonucleotide
agcaaaacaggucuagaaatt

SEQ ID NO: 1673 - DNA, 21 bp, Artificial Sequence
  Description of Artificial Sequence: Synthetic oligonucleotide
  Description of Combined DNA/RNA Molecule: Synthetic oligonucleotide
ucuagaccuguuuugcuuutt

SEQ ID NO: 1674 - DNA, 21 bp, Artificial Sequence
  Description of Artificial Sequence: Synthetic oligonucleotide
  Description of Combined DNA/RNA Molecule: Synthetic oligonucleotide
aaagcaaaacaggucuagatt

SEQ ID NO: 1675 - DNA, 21 bp, Artificial Sequence
  Description of Artificial Sequence: Synthetic oligonucleotide
  Description of Combined DNA/RNA Molecule: Synthetic oligonucleotide
cuagaccuguuuugcuuuutt

SEQ ID NO: 1676 - DNA, 21 bp, Artificial Sequence
  Description of Artificial Sequence: Synthetic oligonucleotide
  Description of Combined DNA/RNA Molecule: Synthetic oligonucleotide
aaaagcaaaacaggucuagtt

SEQ ID NO: 1677 - DNA, 21 bp, Artificial Sequence
  Description of Artificial Sequence: Synthetic oligonucleotide
  Description of Combined DNA/RNA Molecule: Synthetic oligonucleotide
uagaccuguuuugcuuuugtt

SEQ ID NO: 1678 - DNA, 21 bp, Artificial Sequence
  Description of Artificial Sequence: Synthetic oligonucleotide
  Description of Combined DNA/RNA Molecule: Synthetic oligonucleotide
caaaagcaaaacaggucuatt

SEQ ID NO: 1679 - DNA, 21 bp, Artificial Sequence
  Description of Artificial Sequence: Synthetic oligonucleotide
  Description of Combined DNA/RNA Molecule: Synthetic oligonucleotide
agaccuguuuugcuuuugutt

SEQ ID NO: 1680 - DNA, 21 bp, Artificial Sequence
  Description of Artificial Sequence: Synthetic oligonucleotide
  Description of Combined DNA/RNA Molecule: Synthetic oligonucleotide
acaaaagcaaaacaggucutt

SEQ ID NO: 1681 - DNA, 21 bp, Artificial Sequence
  Description of Artificial Sequence: Synthetic oligonucleotide
  Description of Combined DNA/RNA Molecule: Synthetic oligonucleotide
gaccuguuuugcuuuuguatt

SEQ ID NO: 1682 - DNA, 21 bp, Artificial Sequence
  Description of Artificial Sequence: Synthetic oligonucleotide
  Description of Combined DNA/RNA Molecule: Synthetic oligonucleotide
uacaaaagcaaaacagguctt

SEQ ID NO: 1683 - DNA, 21 bp, Artificial Sequence
  Description of Artificial Sequence: Synthetic oligonucleotide
  Description of Combined DNA/RNA Molecule: Synthetic oligonucleotide
accuguuuugcuuuuguaatt

SEQ ID NO: 1684 - DNA, 21 bp, Artificial Sequence
  Description of Artificial Sequence: Synthetic oligonucleotide
  Description of Combined DNA/RNA Molecule: Synthetic oligonucleotide
uuacaaaagcaaaacaggutt

SEQ ID NO: 1685 - DNA, 21 bp, Artificial Sequence
  Description of Artificial Sequence: Synthetic oligonucleotide
  Description of Combined DNA/RNA Molecule: Synthetic oligonucleotide
ccuguuuugcuuuuguaactt

SEQ ID NO: 1686 - DNA, 21 bp, Artificial Sequence
  Description of Artificial Sequence: Synthetic oligonucleotide
  Description of Combined DNA/RNA Molecule: Synthetic oligonucleotide
guuacaaaagcaaaacaggtt

SEQ ID NO: 1687 - DNA, 21 bp, Artificial Sequence
  Description of Artificial Sequence: Synthetic oligonucleotide
  Description of Combined DNA/RNA Molecule: Synthetic oligonucleotide
cuguuuugcuuuuguaacutt

SEQ ID NO: 1688 - DNA, 21 bp, Artificial Sequence
  Description of Artificial Sequence: Synthetic oligonucleotide
  Description of Combined DNA/RNA Molecule: Synthetic oligonucleotide
aguuacaaaagcaaaacagtt

SEQ ID NO: 1689 - DNA, 21 bp, Artificial Sequence
  Description of Artificial Sequence: Synthetic oligonucleotide
  Description of Combined DNA/RNA Molecule: Synthetic oligonucleotide
uguuuugcuuuuguaacuutt

SEQ ID NO: 1690 - DNA, 21 bp, Artificial Sequence
  Description of Artificial Sequence: Synthetic oligonucleotide
  Description of Combined DNA/RNA Molecule: Synthetic oligonucleotide
aaguuacaaaagcaaaacatt

SEQ ID NO: 1691 - DNA, 21 bp, Artificial Sequence
  Description of Artificial Sequence: Synthetic oligonucleotide
  Description of Combined DNA/RNA Molecule: Synthetic oligonucleotide
guuuugcuuuuguaacuugtt

SEQ ID NO: 1692 - DNA, 21 bp, Artificial Sequence
  Description of Artificial Sequence: Synthetic oligonucleotide
  Description of Combined DNA/RNA Molecule: Synthetic oligonucleotide
caaguuacaaaagcaaaactt

SEQ ID NO: 1693 - DNA, 21 bp, Artificial Sequence
  Description of Artificial Sequence: Synthetic oligonucleotide
  Description of Combined DNA/RNA Molecule: Synthetic oligonucleotide
uuuugcuuuuguaacuugatt

SEQ ID NO: 1694 - DNA, 21 bp, Artificial Sequence
  Description of Artificial Sequence: Synthetic oligonucleotide
  Description of Combined DNA/RNA Molecule: Synthetic oligonucleotide
ucaaguuacaaaagcaaaatt

SEQ ID NO: 1695 - DNA, 21 bp, Artificial Sequence
  Description of Artificial Sequence: Synthetic oligonucleotide
  Description of Combined DNA/RNA Molecule: Synthetic oligonucleotide
uuugcuuuuguaacuugaatt

SEQ ID NO: 1696 - DNA, 21 bp, Artificial Sequence
  Description of Artificial Sequence: Synthetic oligonucleotide
  Description of Combined DNA/RNA Molecule: Synthetic oligonucleotide
uucaaguuacaaaagcaaatt

SEQ ID NO: 1697 - DNA, 21 bp, Artificial Sequence
  Description of Artificial Sequence: Synthetic oligonucleotide
  Description of Combined DNA/RNA Molecule: Synthetic oligonucleotide
uugcuuuuguaacuugaagtt

SEQ ID NO: 1698 - DNA, 21 bp, Artificial Sequence
  Description of Artificial Sequence: Synthetic oligonucleotide
  Description of Combined DNA/RNA Molecule: Synthetic oligonucleotide
cuucaaguuacaaaagcaatt

SEQ ID NO: 1699 - DNA, 21 bp, Artificial Sequence
  Description of Artificial Sequence: Synthetic oligonucleotide
  Description of Combined DNA/RNA Molecule: Synthetic oligonucleotide
ugcuuuuguaacuugaagatt

SEQ ID NO: 1700 - DNA, 21 bp, Artificial Sequence
  Description of Artificial Sequence: Synthetic oligonucleotide
  Description of Combined DNA/RNA Molecule: Synthetic oligonucleotide
ucuucaaguuacaaaagcatt

SEQ ID NO: 1701 - DNA, 21 bp, Artificial Sequence
  Description of Artificial Sequence: Synthetic oligonucleotide
  Description of Combined DNA/RNA Molecule: Synthetic oligonucleotide
gcuuuuguaacuugaagautt

SEQ ID NO: 1702 - DNA, 21 bp, Artificial Sequence
  Description of Artificial Sequence: Synthetic oligonucleotide
  Description of Combined DNA/RNA Molecule: Synthetic oligonucleotide
aucuucaaguuacaaaagctt

SEQ ID NO: 1703 - DNA, 21 bp, Artificial Sequence
  Description of Artificial Sequence: Synthetic oligonucleotide
  Description of Combined DNA/RNA Molecule: Synthetic oligonucleotide
cuuuuguaacuugaagauatt

SEQ ID NO: 1704 - DNA, 21 bp, Artificial Sequence
  Description of Artificial Sequence: Synthetic oligonucleotide
  Description of Combined DNA/RNA Molecule: Synthetic oligonucleotide
uaucuucaaguuacaaaagtt

SEQ ID NO: 1705 - DNA, 21 bp, Artificial Sequence
  Description of Artificial Sequence: Synthetic oligonucleotide
  Description of Combined DNA/RNA Molecule: Synthetic oligonucleotide
uuuuguaacuugaagauautt

SEQ ID NO: 1706 - DNA, 21 bp, Artificial Sequence
  Description of Artificial Sequence: Synthetic oligonucleotide
  Description of Combined DNA/RNA Molecule: Synthetic oligonucleotide
auaucuucaaguuacaaaatt

SEQ ID NO: 1707 - DNA, 21 bp, Artificial Sequence
  Description of Artificial Sequence: Synthetic oligonucleotide
  Description of Combined DNA/RNA Molecule: Synthetic oligonucleotide
uuuguaacuugaagauauutt

SEQ ID NO: 1708 - DNA, 21 bp, Artificial Sequence
  Description of Artificial Sequence: Synthetic oligonucleotide
  Description of Combined DNA/RNA Molecule: Synthetic oligonucleotide
aauaucuucaaguuacaaatt

SEQ ID NO: 1709 - DNA, 21 bp, Artificial Sequence
  Description of Artificial Sequence: Synthetic oligonucleotide
  Description of Combined DNA/RNA Molecule: Synthetic oligonucleotide
uuguaacuugaagauauuutt

SEQ ID NO: 1710 - DNA, 21 bp, Artificial Sequence
  Description of Artificial Sequence: Synthetic oligonucleotide
  Description of Combined DNA/RNA Molecule: Synthetic oligonucleotide
aaauaucuucaaguuacaatt

SEQ ID NO: 1711 - DNA, 21 bp, Artificial Sequence
  Description of Artificial Sequence: Synthetic oligonucleotide
  Description of Combined DNA/RNA Molecule: Synthetic oligonucleotide
uguaacuugaagauauuuatt

SEQ ID NO: 1712 - DNA, 21 bp, Artificial Sequence
  Description of Artificial Sequence: Synthetic oligonucleotide
  Description of Combined DNA/RNA Molecule: Synthetic oligonucleotide
uaaauaucuucaaguuacatt

SEQ ID NO: 1713 - DNA, 21 bp, Artificial Sequence
  Description of Artificial Sequence: Synthetic oligonucleotide
  Description of Combined DNA/RNA Molecule: Synthetic oligonucleotide
guaacuugaagauauuuautt

SEQ ID NO: 1714 - DNA, 21 bp, Artificial Sequence
  Description of Artificial Sequence: Synthetic oligonucleotide
  Description of Combined DNA/RNA Molecule: Synthetic oligonucleotide
auaaauaucuucaaguuactt

SEQ ID NO: 1715 - DNA, 21 bp, Artificial Sequence
  Description of Artificial Sequence: Synthetic oligonucleotide
  Description of Combined DNA/RNA Molecule: Synthetic oligonucleotide
uaacuugaagauauuuauutt

SEQ ID NO: 1716 - DNA, 21 bp, Artificial Sequence
  Description of Artificial Sequence: Synthetic oligonucleotide
  Description of Combined DNA/RNA Molecule: Synthetic oligonucleotide
aauaaauaucuucaaguuatt

SEQ ID NO: 1717 - DNA, 21 bp, Artificial Sequence
  Description of Artificial Sequence: Synthetic oligonucleotide
  Description of Combined DNA/RNA Molecule: Synthetic oligonucleotide
aacuugaagauauuuauuctt

SEQ ID NO: 1718 - DNA, 21 bp, Artificial Sequence
  Description of Artificial Sequence: Synthetic oligonucleotide
  Description of Combined DNA/RNA Molecule: Synthetic oligonucleotide
gaauaaauaucuucaaguutt

SEQ ID NO: 1719 - DNA, 21 bp, Artificial Sequence
  Description of Artificial Sequence: Synthetic oligonucleotide
  Description of Combined DNA/RNA Molecule: Synthetic oligonucleotide
acuugaagauauuuauucutt

SEQ ID NO: 1720 - DNA, 21 bp, Artificial Sequence
  Description of Artificial Sequence: Synthetic oligonucleotide
  Description of Combined DNA/RNA Molecule: Synthetic oligonucleotide
agaauaaauaucuucaagutt

SEQ ID NO: 1721 - DNA, 21 bp, Artificial Sequence
  Description of Artificial Sequence: Synthetic oligonucleotide
  Description of Combined DNA/RNA Molecule: Synthetic oligonucleotide
cuugaagauauuuauucugtt

SEQ ID NO: 1722 - DNA, 21 bp, Artificial Sequence
  Description of Artificial Sequence: Synthetic oligonucleotide
  Description of Combined DNA/RNA Molecule: Synthetic oligonucleotide
cagaauaaauaucuucaagtt

SEQ ID NO: 1723 - DNA, 21 bp, Artificial Sequence
  Description of Artificial Sequence: Synthetic oligonucleotide
  Description of Combined DNA/RNA Molecule: Synthetic oligonucleotide
uugaagauauuuauucuggtt

SEQ ID NO: 1724 - DNA, 21 bp, Artificial Sequence
  Description of Artificial Sequence: Synthetic oligonucleotide
  Description of Combined DNA/RNA Molecule: Synthetic oligonucleotide
ccagaauaaauaucuucaatt

SEQ ID NO: 1725 - DNA, 21 bp, Artificial Sequence
  Description of Artificial Sequence: Synthetic oligonucleotide
  Description of Combined DNA/RNA Molecule: Synthetic oligonucleotide
ugaagauauuuauucugggtt

SEQ ID NO: 1726 - DNA, 21 bp, Artificial Sequence
  Description of Artificial Sequence: Synthetic oligonucleotide
  Description of Combined DNA/RNA Molecule: Synthetic oligonucleotide
cccagaauaaauaucuucatt

SEQ ID NO: 1727 - DNA, 21 bp, Artificial Sequence
  Description of Artificial Sequence: Synthetic oligonucleotide
  Description of Combined DNA/RNA Molecule: Synthetic oligonucleotide
gaagauauuuauucugggutt

SEQ ID NO: 1728 - DNA, 21 bp, Artificial Sequence
  Description of Artificial Sequence: Synthetic oligonucleotide
  Description of Combined DNA/RNA Molecule: Synthetic oligonucleotide
acccagaauaaauaucuuctt

SEQ ID NO: 1729 - RNA, 19 nt, Artificial Sequence
  Description of Artificial Sequence: Synthetic oligonucleotide
cccagcugauuagugucua

SEQ ID NO: 1730 - RNA, 19 nt, Artificial Sequence
  Description of Artificial Sequence: Synthetic oligonucleotide
ccagcugauuagugucuaa

SEQ ID NO: 1731 - RNA, 19 nt, Artificial Sequence
  Description of Artificial Sequence: Synthetic oligonucleotide
cucccagaggucuacccag

SEQ ID NO: 1732 - RNA, 19 nt, Artificial Sequence
  Description of Artificial Sequence: Synthetic oligonucleotide
gaucacccugaauucauug

SEQ ID NO: 1733 - RNA, 19 nt, Artificial Sequence
  Description of Artificial Sequence: Synthetic oligonucleotide
ucacccugaauucauuguc

SEQ ID NO: 1734 - RNA, 19 nt, Artificial Sequence
  Description of Artificial Sequence: Synthetic oligonucleotide
ccccagcugauuagugucu

SEQ ID NO: 1735 - RNA, 19 nt, Artificial Sequence
  Description of Artificial Sequence: Synthetic oligonucleotide
aucacccugaauucauugu

SEQ ID NO: 1736 - RNA, 19 nt, Artificial Sequence
  Description of Artificial Sequence: Synthetic oligonucleotide
cauuuauuuaaaacuaccc

SEQ ID NO: 1737 - RNA, 19 nt, Artificial Sequence
  Description of Artificial Sequence: Synthetic oligonucleotide
acugaaaaacagaguagca

SEQ ID NO: 1738 - RNA, 19 nt, Artificial Sequence
  Description of Artificial Sequence: Synthetic oligonucleotide
ccauuuauuuaaaacuacc

SEQ ID NO: 1739 - RNA, 19 nt, Artificial Sequence
  Description of Artificial Sequence: Synthetic oligonucleotide
uugagaaccaggaguuaag

SEQ ID NO: 1740 - RNA, 19 nt, Artificial Sequence
  Description of Artificial Sequence: Synthetic oligonucleotide
cacccugaauucauugucu

SEQ ID NO: 1741 - RNA, 19 nt, Artificial Sequence
  Description of Artificial Sequence: Synthetic oligonucleotide
aacugaaaaacagaguagc

SEQ ID NO: 1742 - RNA, 19 nt, Artificial Sequence
  Description of Artificial Sequence: Synthetic oligonucleotide
cugaaaaacagaguagcag

SEQ ID NO: 1743 - RNA, 19 nt, Artificial Sequence
  Description of Artificial Sequence: Synthetic oligonucleotide
agaaaaucagcuuuuacga

SEQ ID NO: 1744 - RNA, 19 nt, Artificial Sequence
  Description of Artificial Sequence: Synthetic oligonucleotide
uccccagcugauuaguguc

SEQ ID NO: 1745 - RNA, 19 nt, Artificial Sequence
  Description of Artificial Sequence: Synthetic oligonucleotide
uacuuauuauguaaggguc

SEQ ID NO: 1746 - RNA, 19 nt, Artificial Sequence
  Description of Artificial Sequence: Synthetic oligonucleotide
uaucuuaaaagggugguag

SEQ ID NO: 1747 - RNA, 19 nt, Artificial Sequence
  Description of Artificial Sequence: Synthetic oligonucleotide
ccauggauucuggcgguau

SEQ ID NO: 1748 - RNA, 19 nt, Artificial Sequence
  Description of Artificial Sequence: Synthetic oligonucleotide
uuaaugaacuaauucguuu

SEQ ID NO: 1749 - RNA, 19 nt, Artificial Sequence
  Description of Artificial Sequence: Synthetic oligonucleotide
agggucauuagacaaaugu

SEQ ID NO: 1750 - RNA, 19 nt, Artificial Sequence
  Description of Artificial Sequence: Synthetic oligonucleotide
ugaacuaauucguuuugac

SEQ ID NO: 1751 - RNA, 19 nt, Artificial Sequence
  Description of Artificial Sequence: Synthetic oligonucleotide
uuccccagcugauuagugu

SEQ ID NO: 1752 - RNA, 19 nt, Artificial Sequence
  Description of Artificial Sequence: Synthetic oligonucleotide
uauguaagggucauuagac

SEQ ID NO: 1753 - RNA, 19 nt, Artificial Sequence
  Description of Artificial Sequence: Synthetic oligonucleotide
uagacacuaaucagcuggg

SEQ ID NO: 1754 - RNA, 19 nt, Artificial Sequence
  Description of Artificial Sequence: Synthetic oligonucleotide
uuagacacuaaucagcugg

SEQ ID NO: 1755 - RNA, 19 nt, Artificial Sequence
  Description of Artificial Sequence: Synthetic oligonucleotide
cuggguagaccucugggag

SEQ ID NO: 1756 - RNA, 19 nt, Artificial Sequence
  Description of Artificial Sequence: Synthetic oligonucleotide
caaugaauucagggugauc

SEQ ID NO: 1757 - RNA, 19 nt, Artificial Sequence
  Description of Artificial Sequence: Synthetic oligonucleotide
gacaaugaauucaggguga

SEQ ID NO: 1758 - RNA, 19 nt, Artificial Sequence
  Description of Artificial Sequence: Synthetic oligonucleotide
agacacuaaucagcugggg

SEQ ID NO: 1759 - RNA, 19 nt, Artificial Sequence
  Description of Artificial Sequence: Synthetic oligonucleotide
acaaugaauucagggugau

SEQ ID NO: 1760 - RNA, 19 nt, Artificial Sequence
  Description of Artificial Sequence: Synthetic oligonucleotide
ggguaguuuuaaauaaaug

SEQ ID NO: 1761 - RNA, 19 nt, Artificial Sequence
  Description of Artificial Sequence: Synthetic oligonucleotide
ugcuacucuguuuuucagu

SEQ ID NO: 1762 - RNA, 19 nt, Artificial Sequence
  Description of Artificial Sequence: Synthetic oligonucleotide
gguaguuuuaaauaaaugg

SEQ ID NO: 1763 - RNA, 19 nt, Artificial Sequence
  Description of Artificial Sequence: Synthetic oligonucleotide
cuuaacuccugguucucaa

SEQ ID NO: 1764 - RNA, 19 nt, Artificial Sequence
  Description of Artificial Sequence: Synthetic oligonucleotide
agacaaugaauucagggug

SEQ ID NO: 1765 - RNA, 19 nt, Artificial Sequence
  Description of Artificial Sequence: Synthetic oligonucleotide
gcuacucuguuuuucaguu

SEQ ID NO: 1766 - RNA, 19 nt, Artificial Sequence
  Description of Artificial Sequence: Synthetic oligonucleotide
cugcuacucuguuuuucag

SEQ ID NO: 1767 - RNA, 19 nt, Artificial Sequence
  Description of Artificial Sequence: Synthetic oligonucleotide
ucguaaaagcugauuuucu

SEQ ID NO: 1768 - RNA, 19 nt, Artificial Sequence
  Description of Artificial Sequence: Synthetic oligonucleotide
gacacuaaucagcugggga

SEQ ID NO: 1769 - RNA, 19 nt, Artificial Sequence
  Description of Artificial Sequence: Synthetic oligonucleotide
gacccuuacauaauaagua

SEQ ID NO: 1770 - RNA, 19 nt, Artificial Sequence
  Description of Artificial Sequence: Synthetic oligonucleotide
cuaccacccuuuuaagaua

SEQ ID NO: 1771 - RNA, 19 nt, Artificial Sequence
  Description of Artificial Sequence: Synthetic oligonucleotide
auaccgccagaauccaugg

SEQ ID NO: 1772 - RNA, 19 nt, Artificial Sequence
  Description of Artificial Sequence: Synthetic oligonucleotide
aaacgaauuaguucauuaa

SEQ ID NO: 1773 - RNA, 19 nt, Artificial Sequence
  Description of Artificial Sequence: Synthetic oligonucleotide
acauuugucuaaugacccu

SEQ ID NO: 1774 - RNA, 19 nt, Artificial Sequence
  Description of Artificial Sequence: Synthetic Oligonucleotide
gucaaaacgaauuaguuca

SEQ ID NO: 1775 - RNA, 19 nt, Artificial Sequence
  Description of Artificial Sequence: Synthetic oligonucleotide
  Description of Combined DNA/RNA Molecule: Synthetic oligonucleotide
acacuaaucagcuggggaa

SEQ ID NO: 1776 - RNA, 19 nt, Artificial Sequence
  Description of Artificial Sequence: Synthetic Oligonucleotide
gucuaaugacccuuacaua

SEQ ID NO: 1777 - DNA, 21 bp, Artificial Sequence
  Description of Artificial Sequence: Synthetic oligonucleotide
  Description of Combined DNA/RNA Molecule: Synthetic oligonucleotide
ccagcugauuagugucuaatt

SEQ ID NO: 1778 - DNA, 21 bp, Artificial Sequence
  Description of Artificial Sequence: Synthetic oligonucleotide
  Description of Combined DNA/RNA Molecule: Synthetic oligonucleotide
cucccagaggucuacccagtt

SEQ ID NO: 1779 - DNA, 21 bp, Artificial Sequence
  Description of Artificial Sequence: Synthetic oligonucleotide
  Description of Combined DNA/RNA Molecule: Synthetic oligonucleotide
gaucacccugaauucauugtt

SEQ ID NO: 1780 - DNA, 21 bp, Artificial Sequence
  Description of Artificial Sequence: Synthetic oligonucleotide
  Description of Combined DNA/RNA Molecule: Synthetic oligonucleotide
ucacccugaauucauuguctt

SEQ ID NO: 1781 - DNA, 21 bp, Artificial Sequence
  Description of Artificial Sequence: Synthetic oligonucleotide
  Description of Combined DNA/RNA Molecule: Synthetic oligonucleotide
ccccagcugauuagugucutt

SEQ ID NO: 1782 - DNA, 21 bp, Artificial Sequence
  Description of Artificial Sequence: Synthetic oligonucleotide
  Description of Combined DNA/RNA Molecule: Synthetic oligonucleotide
aucacccugaauucauugutt

SEQ ID NO: 1783 - DNA, 21 bp, Artificial Sequence
  Description of Artificial Sequence: Synthetic oligonucleotide
  Description of Combined DNA/RNA Molecule: Synthetic oligonucleotide
cauuuauuuaaaacuaccctt

SEQ ID NO: 1784 - DNA, 21 bp, Artificial Sequence
  Description of Artificial Sequence: Synthetic oligonucleotide
  Description of Combined DNA/RNA Molecule: Synthetic oligonucleotide
acugaaaaacagaguagcatt

SEQ ID NO: 1785 - DNA, 21 bp, Artificial Sequence
  Description of Artificial Sequence: Synthetic oligonucleotide
  Description of Combined DNA/RNA Molecule: Synthetic oligonucleotide
ccauuuauuuaaaacuacctt

SEQ ID NO: 1786 - DNA, 21 bp, Artificial Sequence
  Description of Artificial Sequence: Synthetic oligonucleotide
  Description of Combined DNA/RNA Molecule: Synthetic oligonucleotide
uugagaaccaggaguuaagtt

SEQ ID NO: 1787 - DNA, 21 bp, Artificial Sequence
  Description of Artificial Sequence: Synthetic oligonucleotide
  Description of Combined DNA/RNA Molecule: Synthetic oligonucleotide
cacccugaauucauugucutt

SEQ ID NO: 1788 - DNA, 21 bp, Artificial Sequence
  Description of Artificial Sequence: Synthetic oligonucleotide
  Description of Combined DNA/RNA Molecule: Synthetic oligonucleotide
aacugaaaaacagaguagctt

SEQ ID NO: 1789 - DNA, 21 bp, Artificial Sequence
  Description of Artificial Sequence: Synthetic oligonucleotide
  Description of Combined DNA/RNA Molecule: Synthetic oligonucleotide
cugaaaaacagaguagcagtt

SEQ ID NO: 1790 - DNA, 21 bp, Artificial Sequence
  Description of Artificial Sequence: Synthetic oligonucleotide
  Description of Combined DNA/RNA Molecule: Synthetic oligonucleotide
agaaaaucagcuuuuacgatt

SEQ ID NO: 1791 - DNA, 21 bp, Artificial Sequence
  Description of Artificial Sequence: Synthetic oligonucleotide
  Description of Combined DNA/RNA Molecule: Synthetic oligonucleotide
uccccagcugauuaguguctt

SEQ ID NO: 1792 - DNA, 21 bp, Artificial Sequence
  Description of Artificial Sequence: Synthetic oligonucleotide
  Description of Combined DNA/RNA Molecule: Synthetic oligonucleotide
uacuuauuauguaaggguctt

SEQ ID NO: 1793 - DNA, 21 bp, Artificial Sequence
  Description of Artificial Sequence: Synthetic oligonucleotide
  Description of Combined DNA/RNA Molecule: Synthetic oligonucleotide
uaucuuaaaagggugguagtt

SEQ ID NO: 1794 - DNA, 21 bp, Artificial Sequence
  Description of Artificial Sequence: Synthetic oligonucleotide
  Description of Combined DNA/RNA Molecule: Synthetic oligonucleotide
ccauggauucuggcgguautt

SEQ ID NO: 1795 - DNA, 21 bp, Artificial Sequence
  Description of Artificial Sequence: Synthetic oligonucleotide
  Description of Combined DNA/RNA Molecule: Synthetic oligonucleotide
uuaaugaacuaauucguuutt

SEQ ID NO: 1796 - DNA, 21 bp, Artificial Sequence
  Description of Artificial Sequence: Synthetic oligonucleotide
  Description of Combined DNA/RNA Molecule: Synthetic oligonucleotide
agggucauuagacaaaugutt

SEQ ID NO: 1797 - DNA, 21 bp, Artificial Sequence
  Description of Artificial Sequence: Synthetic oligonucleotide
  Description of Combined DNA/RNA Molecule: Synthetic oligonucleotide
ugaacuaauucguuuugactt

SEQ ID NO: 1798 - DNA, 21 bp, Artificial Sequence
  Description of Artificial Sequence: Synthetic oligonucleotide
  Description of Combined DNA/RNA Molecule: Synthetic oligonucleotide
uuccccagcugauuagugutt

SEQ ID NO: 1799 - DNA, 21 bp, Artificial Sequence
  Description of Artificial Sequence: Synthetic oligonucleotide
  Description of Combined DNA/RNA Molecule: Synthetic oligonucleotide
uauguaagggucauuagactt

SEQ ID NO: 1800 - DNA, 21 bp, Artificial Sequence
  Description of Artificial Sequence: Synthetic oligonucleotide
  Description of Combined DNA/RNA Molecule: Synthetic oligonucleotide
uagacacuaaucagcugggtt

SEQ ID NO: 1801 - DNA, 21 bp, Artificial Sequence
  Description of Artificial Sequence: Synthetic oligonucleotide
  Description of Combined DNA/RNA Molecule: Synthetic oligonucleotide
uuagacacuaaucagcuggtt

SEQ ID NO: 1802 - DNA, 21 bp, Artificial Sequence
  Description of Artificial Sequence: Synthetic oligonucleotide
  Description of Combined DNA/RNA Molecule: Synthetic oligonucleotide
cuggguagaccucugggagtt

SEQ ID NO: 1803 - DNA, 21 bp, Artificial Sequence
  Description of Artificial Sequence: Synthetic oligonucleotide
  Description of Combined DNA/RNA Molecule: Synthetic oligonucleotide
caaugaauucagggugauctt

SEQ ID NO: 1804 - DNA, 21 bp, Artificial Sequence
  Description of Artificial Sequence: Synthetic oligonucleotide
  Description of Combined DNA/RNA Molecule: Synthetic oligonucleotide
gacaaugaauucagggugatt

SEQ ID NO: 1805 - DNA, 21 bp, Artificial Sequence
  Description of Artificial Sequence: Synthetic oligonucleotide
  Description of Combined DNA/RNA Molecule: Synthetic oligonucleotide
agacacuaaucagcuggggtt

SEQ ID NO: 1806 - DNA, 21 bp, Artificial Sequence
  Description of Artificial Sequence: Synthetic oligonucleotide
  Description of Combined DNA/RNA Molecule: Synthetic oligonucleotide
acaaugaauucagggugautt

SEQ ID NO: 1807 - DNA, 21 bp, Artificial Sequence
  Description of Artificial Sequence: Synthetic oligonucleotide
  Description of Combined DNA/RNA Molecule: Synthetic oligonucleotide
ggguaguuuuaaauaaaugtt

SEQ ID NO: 1808 - DNA, 21 bp, Artificial Sequence
  Description of Artificial Sequence: Synthetic oligonucleotide
  Description of Combined DNA/RNA Molecule: Synthetic oligonucleotide
ugcuacucuguuuuucagutt

SEQ ID NO: 1809 - DNA, 21 bp, Artificial Sequence
  Description of Artificial Sequence: Synthetic oligonucleotide
  Description of Combined DNA/RNA Molecule: Synthetic oligonucleotide
gguaguuuuaaauaaauggtt

SEQ ID NO: 1810 - DNA, 21 bp, Artificial Sequence
  Description of Artificial Sequence: Synthetic oligonucleotide
  Description of Combined DNA/RNA Molecule: Synthetic oligonucleotide
cuuaacuccugguucucaatt

SEQ ID NO: 1811 - DNA, 21 bp, Artificial Sequence
  Description of Artificial Sequence: Synthetic oligonucleotide
  Description of Combined DNA/RNA Molecule: Synthetic oligonucleotide
agacaaugaauucagggugtt

SEQ ID NO: 1812 - DNA, 21 bp, Artificial Sequence
  Description of Artificial Sequence: Synthetic oligonucleotide
  Description of Combined DNA/RNA Molecule: Synthetic oligonucleotide
gcuacucuguuuuucaguutt

SEQ ID NO: 1813 - DNA, 21 bp, Artificial Sequence
  Description of Artificial Sequence: Synthetic oligonucleotide
  Description of Combined DNA/RNA Molecule: Synthetic oligonucleotide
cugcuacucuguuuuucagtt

SEQ ID NO: 1814 - DNA, 21 bp, Artificial Sequence
  Description of Artificial Sequence: Synthetic oligonucleotide
  Description of Combined DNA/RNA Molecule: Synthetic oligonucleotide
ucguaaaagcugauuuucutt

SEQ ID NO: 1815 - DNA, 21 bp, Artificial Sequence
  Description of Artificial Sequence: Synthetic oligonucleotide
  Description of Combined DNA/RNA Molecule: Synthetic oligonucleotide
gacacuaaucagcuggggatt

SEQ ID NO: 1816 - DNA, 21 bp, Artificial Sequence
  Description of Artificial Sequence: Synthetic oligonucleotide
  Description of Combined DNA/RNA Molecule: Synthetic oligonucleotide
gacccuuacauaauaaguatt

SEQ ID NO: 1817 - DNA, 21 bp, Artificial Sequence
  Description of Artificial Sequence: Synthetic oligonucleotide
  Description of Combined DNA/RNA Molecule: Synthetic oligonucleotide
cuaccacccuuuuaagauatt

SEQ ID NO: 1818 - DNA, 21 bp, Artificial Sequence
  Description of Artificial Sequence: Synthetic oligonucleotide
  Description of Combined DNA/RNA Molecule: Synthetic oligonucleotide
auaccgccagaauccauggtt

SEQ ID NO: 1819 - DNA, 21 bp, Artificial Sequence
  Description of Artificial Sequence: Synthetic oligonucleotide
  Description of Combined DNA/RNA Molecule: Synthetic oligonucleotide
aaacgaauuaguucauuaatt

SEQ ID NO: 1820 - DNA, 21 bp, Artificial Sequence
  Description of Artificial Sequence: Synthetic oligonucleotide
  Description of Combined DNA/RNA Molecule: Synthetic oligonucleotide
acauuugucuaaugacccutt

SEQ ID NO: 1821 - DNA, 21 bp, Artificial Sequence
  Description of Artificial Sequence: Synthetic oligonucleotide
  Description of Combined DNA/RNA Molecule: Synthetic oligonucleotide
gucaaaacgaauuaguucatt

SEQ ID NO: 1822 - DNA, 21 bp, Artificial Sequence
  Description of Artificial Sequence: Synthetic oligonucleotide
  Description of Combined DNA/RNA Molecule: Synthetic oligonucleotide
acacuaaucagcuggggaatt

SEQ ID NO: 1823 - DNA, 21 bp, Artificial Sequence
  Description of Artificial Sequence: Synthetic oligonucleotide
  Description of Combined DNA/RNA Molecule: Synthetic oligonucleotide
gucuaaugacccuuacauatt

SEQ ID NO: 1824 - RNA, 21 nt, Artificial Sequence
  Description of Artificial Sequence: Synthetic oligonucleotide
  modified_base (20)..(21): a, c, g, u, unknown or other
cugcuucugucggggcagcnn

SEQ ID NO: 1825 - RNA, 21 nt, Artificial Sequence
  Description of Artificial Sequence: Synthetic oligonucleotide
  modified_base (20)..(21): a, c, g, u, unknown or other
gagcuggguaucucaaaucnn

SEQ ID NO: 1826 - RNA, 21 nt, Artificial Sequence
  Description of Artificial Sequence: Synthetic oligonucleotide
  modified_base (20)..(21): a, c, g, u, unknown or other
ugcuucugucggggcagccnn

SEQ ID NO: 1827 - RNA, 21 nt, Artificial Sequence
  Description of Artificial Sequence: Synthetic oligonucleotide
  modified_base (20)..(21): a, c, g, u, unknown or other
agcuggguaucucaaaucunn

SEQ ID NO: 1828 - RNA, 21 nt, Artificial Sequence
  Description of Artificial Sequence: Synthetic oligonucleotide
  modified_base (20)..(21): a, c, g, u, unknown or other
gcuggguaucucaaaucugnn

SEQ ID NO: 1829 - RNA, 21 nt, Artificial Sequence
  Description of Artificial Sequence: Synthetic oligonucleotide
  modified_base (20)..(21): a, c, g, u, unknown or other
cuggguaucucaaaucugcnn

SEQ ID NO: 1830 - RNA, 21 nt, Artificial Sequence
  Description of Artificial Sequence: Synthetic oligonucleotide
  modified_base (20)..(21): a, c, g, u, unknown or other
uggguaucucaaaucugcunn

SEQ ID NO: 1831 - RNA, 21 nt, Artificial Sequence
  Description of Artificial Sequence: Synthetic oligonucleotide
  modified_base (20)..(21): a, c, g, u, unknown or other
ggguaucucaaaucugcuunn

SEQ ID NO: 1832 - RNA, 21 nt, Artificial Sequence
  Description of Artificial Sequence: Synthetic oligonucleotide
  modified_base (20)..(21): a, c, g, u, unknown or other
gguaucucaaaucugcuuunn

SEQ ID NO: 1833 - RNA, 21 nt, Artificial Sequence
  Description of Artificial Sequence: Synthetic oligonucleotide
  modified_base (20)..(21): a, c, g, u, unknown or other
guaucucaaaucugcuuucnn

SEQ ID NO: 1834 - RNA, 21 nt, Artificial Sequence
  Description of Artificial Sequence: Synthetic oligonucleotide
  modified_base (20)..(21): a, c, g, u, unknown or other
uaucucaaaucugcuuucann

SEQ ID NO: 1835 - RNA, 21 nt, Artificial Sequence
  Description of Artificial Sequence: Synthetic oligonucleotide
  modified_base (20)..(21): a, c, g, u, unknown or other
aucucaaaucugcuuucaunn

SEQ ID NO: 1836 - RNA, 21 nt, Artificial Sequence
  Description of Artificial Sequence: Synthetic oligonucleotide
  modified_base (20)..(21): a, c, g, u, unknown or other
ucucaaaucugcuuucaucnn

SEQ ID NO: 1837 - RNA, 21 nt, Artificial Sequence
  Description of Artificial Sequence: Synthetic oligonucleotide
  modified_base (20)..(21): a, c, g, u, unknown or other
gcuucugucggggcagcccnn

SEQ ID NO: 1838 - RNA, 21 nt, Artificial Sequence
  Description of Artificial Sequence: Synthetic oligonucleotide
  modified_base (20)..(21): a, c, g, u, unknown or other
cucaaaucugcuuucauccnn

SEQ ID NO: 1839 - RNA, 21 nt, Artificial Sequence
  Description of Artificial Sequence: Synthetic oligonucleotide
  modified_base (20)..(21): a, c, g, u, unknown or other
ucaaaucugcuuucauccann

SEQ ID NO: 1840 - RNA, 21 nt, Artificial Sequence
  Description of Artificial Sequence: Synthetic oligonucleotide
  modified_base (20)..(21): a, c, g, u, unknown or other
caaaucugcuuucauccagnn

SEQ ID NO: 1841 - RNA, 21 nt, Artificial Sequence
  Description of Artificial Sequence: Synthetic oligonucleotide
  modified_base (20)..(21): a, c, g, u, unknown or other
aaaucugcuuucauccagcnn

SEQ ID NO: 1842 - RNA, 21 nt, Artificial Sequence
  Description of Artificial Sequence: Synthetic oligonucleotide
  modified_base (20)..(21): a, c, g, u, unknown or other
aaucugcuuucauccagccnn

SEQ ID NO: 1843 - RNA, 21 nt, Artificial Sequence
  Description of Artificial Sequence: Synthetic oligonucleotide
  modified_base (20)..(21): a, c, g, u, unknown or other
aucugcuuucauccagccann

SEQ ID NO: 1844 - RNA, 21 nt, Artificial Sequence
  Description of Artificial Sequence: Synthetic oligonucleotide
  modified_base (20)..(21): a, c, g, u, unknown or other
ucugcuuucauccagccacnn

SEQ ID NO: 1845 - RNA, 21 nt, Artificial Sequence
  Description of Artificial Sequence: Synthetic oligonucleotide
  modified_base (20)..(21): a, c, g, u, unknown or other
cugcuuucauccagccacunn

SEQ ID NO: 1846 - RNA, 21 nt, Artificial Sequence
  Description of Artificial Sequence: Synthetic oligonucleotide
  modified_base (20)..(21): a, c, g, u, unknown or other
ugcuuucauccagccacugnn

SEQ ID NO: 1847 - RNA, 21 nt, Artificial Sequence
  Description of Artificial Sequence: Synthetic oligonucleotide
  modified_base (20)..(21): a, c, g, u, unknown or other
gcuuucauccagccacugcnn

SEQ ID NO: 1848 - RNA, 21 nt, Artificial Sequence
  Description of Artificial Sequence: Synthetic oligonucleotide
  modified_base (20)..(21): a, c, g, u, unknown or other
cuucugucggggcagcccgnn

SEQ ID NO: 1849 - RNA, 21 nt, Artificial Sequence
  Description of Artificial Sequence: Synthetic oligonucleotide
  modified_base (20)..(21): a, c, g, u, unknown or other
cuuucauccagccacugccnn

SEQ ID NO: 1850 - RNA, 21 nt, Artificial Sequence
  Description of Artificial Sequence: Synthetic oligonucleotide
  modified_base (20)..(21): a, c, g, u, unknown or other
uuucauccagccacugcccnn

SEQ ID NO: 1851 - RNA, 21 nt, Artificial Sequence
  Description of Artificial Sequence: Synthetic oligonucleotide
  modified_base (20)..(21): a, c, g, u, unknown or other
uucugucggggcagcccgcnn

SEQ ID NO: 1852 - RNA, 21 nt, Artificial Sequence
  Description of Artificial Sequence: Synthetic oligonucleotide
  modified_base (20)..(21): a, c, g, u, unknown or other
ucugucggggcagcccgccnn

SEQ ID NO: 1853 - RNA, 21 nt, Artificial Sequence
  Description of Artificial Sequence: Synthetic oligonucleotide
  modified_base (20)..(21): a, c, g, u, unknown or other
ccaucuuccugccuacuggnn

SEQ ID NO: 1854 - RNA, 21 nt, Artificial Sequence
  Description of Artificial Sequence: Synthetic oligonucleotide
  modified_base (20)..(21): a, c, g, u, unknown or other
caucuuccugccuacuggann

SEQ ID NO: 1855 - RNA, 21 nt, Artificial Sequence
  Description of Artificial Sequence: Synthetic oligonucleotide
  modified_base (20)..(21): a, c, g, u, unknown or other
aucuuccugccuacuggaunn

SEQ ID NO: 1856 - RNA, 21 nt, Artificial Sequence
  Description of Artificial Sequence: Synthetic oligonucleotide
  modified_base (20)..(21): a, c, g, u, unknown or other
ucuuccugccuacuggaugnn

SEQ ID NO: 1857 - RNA, 21 nt, Artificial Sequence
  Description of Artificial Sequence: Synthetic oligonucleotide
  modified_base (20)..(21): a, c, g, u, unknown or other
cuuccugccuacuggaugcnn

SEQ ID NO: 1858 - RNA, 21 nt, Artificial Sequence
  Description of Artificial Sequence: Synthetic oligonucleotide
  modified_base (20)..(21): a, c, g, u, unknown or other
uuccugccuacuggaugcunn

SEQ ID NO: 1859 - RNA, 21 nt, Artificial Sequence
  Description of Artificial Sequence: Synthetic oligonucleotide
  modified_base (20)..(21): a, c, g, u, unknown or other
cugucggggcagcccgccunn

SEQ ID NO: 1860 - RNA, 21 nt, Artificial Sequence
  Description of Artificial Sequence: Synthetic oligonucleotide
  modified_base (20)..(21): a, c, g, u, unknown or other
uccugccuacuggaugcuunn

SEQ ID NO: 1861 - RNA, 21 nt, Artificial Sequence
  Description of Artificial Sequence: Synthetic oligonucleotide
  modified_base (20)..(21): a, c, g, u, unknown or other
ccugccuacuggaugcuuann

SEQ ID NO: 1862 - RNA, 21 nt, Artificial Sequence
  Description of Artificial Sequence: Synthetic oligonucleotide
  modified_base (20)..(21): a, c, g, u, unknown or other
cugccuacuggaugcuuacnn

SEQ ID NO: 1863 - RNA, 21 nt, Artificial Sequence
  Description of Artificial Sequence: Synthetic oligonucleotide
  modified_base (20)..(21): a, c, g, u, unknown or other
ugccuacuggaugcuuacann

SEQ ID NO: 1864 - RNA, 21 nt, Artificial Sequence
  Description of Artificial Sequence: Synthetic oligonucleotide
  modified_base (20)..(21): a, c, g, u, unknown or other
gccuacuggaugcuuacagnn

SEQ ID NO: 1865 - RNA, 21 nt, Artificial Sequence
  Description of Artificial Sequence: Synthetic oligonucleotide
  modified_base (20)..(21): a, c, g, u, unknown or other
ccuacuggaugcuuacagunn

SEQ ID NO: 1866 - RNA, 21 nt, Artificial Sequence
  Description of Artificial Sequence: Synthetic oligonucleotide
  modified_base (20)..(21): a, c, g, u, unknown or other
cuacuggaugcuuacagugnn

SEQ ID NO: 1867 - RNA, 21 nt, Artificial Sequence
  Description of Artificial Sequence: Synthetic oligonucleotide
  modified_base (20)..(21): a, c, g, u, unknown or other
uacuggaugcuuacagugann

SEQ ID NO: 1868 - RNA, 21 nt, Artificial Sequence
  Description of Artificial Sequence: Synthetic oligonucleotide
  modified_base (20)..(21): a, c, g, u, unknown or other
acuggaugcuuacagugacnn

SEQ ID NO: 1869 - RNA, 21 nt, Artificial Sequence
  Description of Artificial Sequence: Synthetic oligonucleotide
  modified_base (20)..(21): a, c, g, u, unknown or other
cuggaugcuuacagugacunn

SEQ ID NO: 1870 - RNA, 21 nt, Artificial Sequence
  Description of Artificial Sequence: Synthetic oligonucleotide
  modified_base (20)..(21): a, c, g, u, unknown or other
ugucggggcagcccgccucnn

SEQ ID NO: 1871 - RNA, 21 nt, Artificial Sequence
  Description of Artificial Sequence: Synthetic oligonucleotide
  modified_base (20)..(21): a, c, g, u, unknown or other
uggaugcuuacagugacugnn

SEQ ID NO: 1872 - RNA, 21 nt, Artificial Sequence
  Description of Artificial Sequence: Synthetic oligonucleotide
  modified_base (20)..(21): a, c, g, u, unknown or other
ggaugcuuacagugacugunn

SEQ ID NO: 1873 - RNA, 21 nt, Artificial Sequence
  Description of Artificial Sequence: Synthetic oligonucleotide
  modified_base (20)..(21): a, c, g, u, unknown or other
gaugcuuacagugacugugnn

SEQ ID NO: 1874 - RNA, 21 nt, Artificial Sequence
  Description of Artificial Sequence: Synthetic oligonucleotide
  modified_base (20)..(21): a, c, g, u, unknown or other
augcuuacagugacuguggnn

SEQ ID NO: 1875 - RNA, 21 nt, Artificial Sequence
  Description of Artificial Sequence: Synthetic oligonucleotide
  modified_base (20)..(21): a, c, g, u, unknown or other
ugcuuacagugacuguggann

SEQ ID NO: 1876 - RNA, 21 nt, Artificial Sequence
  Description of Artificial Sequence: Synthetic oligonucleotide
  modified_base (20)..(21): a, c, g, u, unknown or other
gcuuacagugacuguggaunn

SEQ ID NO: 1877 - RNA, 21 nt, Artificial Sequence
  Description of Artificial Sequence: Synthetic oligonucleotide
  modified_base (20)..(21): a, c, g, u, unknown or other
cuuacagugacuguggauann

SEQ ID NO: 1878 - RNA, 21 nt, Artificial Sequence
  Description of Artificial Sequence: Synthetic oligonucleotide
  modified_base (20)..(21): a, c, g, u, unknown or other
gucggggcagcccgccuccnn

SEQ ID NO: 1879 - RNA, 21 nt, Artificial Sequence
  Description of Artificial Sequence: Synthetic oligonucleotide
  modified_base (20)..(21): a, c, g, u, unknown or other
ucggggcagcccgccuccgnn

SEQ ID NO: 1880 - RNA, 21 nt, Artificial Sequence
  Description of Artificial Sequence: Synthetic oligonucleotide
  modified_base (20)..(21): a, c, g, u, unknown or other
cggggcagcccgccuccgcnn

SEQ ID NO: 1881 - RNA, 21 nt, Artificial Sequence
  Description of Artificial Sequence: Synthetic oligonucleotide
  modified_base (20)..(21): a, c, g, u, unknown or other
ggggcagcccgccuccgccnn

SEQ ID NO: 1882 - RNA, 21 nt, Artificial Sequence
  Description of Artificial Sequence: Synthetic oligonucleotide
  modified_base (20)..(21): a, c, g, u, unknown or other
uucagugacauguccucucnn

SEQ ID NO: 1883 - RNA, 21 nt, Artificial Sequence
  Description of Artificial Sequence: Synthetic oligonucleotide
  modified_base (20)..(21): a, c, g, u, unknown or other
gggcagcccgccuccgccgnn

SEQ ID NO: 1884 - RNA, 21 nt, Artificial Sequence
  Description of Artificial Sequence: Synthetic oligonucleotide
  modified_base (20)..(21): a, c, g, u, unknown or other
ggcagcccgccuccgccgcnn

SEQ ID NO: 1885 - RNA, 21 nt, Artificial Sequence
  Description of Artificial Sequence: Synthetic oligonucleotide
  modified_base (20)..(21): a, c, g, u, unknown or other
gcuugguguaaaccauucunn

SEQ ID NO: 1886 - RNA, 21 nt, Artificial Sequence
  Description of Artificial Sequence: Synthetic oligonucleotide
  modified_base (20)..(21): a, c, g, u, unknown or other
cuugguguaaaccauucuunn

SEQ ID NO: 1887 - RNA, 21 nt, Artificial Sequence
  Description of Artificial Sequence: Synthetic oligonucleotide
  modified_base (20)..(21): a, c, g, u, unknown or other
uugguguaaaccauucuugnn

SEQ ID NO: 1888 - RNA, 21 nt, Artificial Sequence
  Description of Artificial Sequence: Synthetic oligonucleotide
  modified_base (20)..(21): a, c, g, u, unknown or other
ugguguaaaccauucuuggnn

SEQ ID NO: 1889 - RNA, 21 nt, Artificial Sequence
  Description of Artificial Sequence: Synthetic oligonucleotide
  modified_base (20)..(21): a, c, g, u, unknown or other
gguguaaaccauucuugggnn

SEQ ID NO: 1890 - RNA, 21 nt, Artificial Sequence
  Description of Artificial Sequence: Synthetic oligonucleotide
  modified_base (20)..(21): a, c, g, u, unknown or other
guguaaaccauucuugggann

SEQ ID NO: 1891 - RNA, 21 nt, Artificial Sequence
  Description of Artificial Sequence: Synthetic oligonucleotide
  modified_base (20)..(21): a, c, g, u, unknown or other
gcagcccgccuccgccgccnn

SEQ ID NO: 1892 - RNA, 21 nt, Artificial Sequence
  Description of Artificial Sequence: Synthetic oligonucleotide
  modified_base (20)..(21): a, c, g, u, unknown or other
uguaaaccauucuugggagnn

SEQ ID NO: 1893 - RNA, 21 nt, Artificial Sequence
  Description of Artificial Sequence: Synthetic oligonucleotide
  modified_base (20)..(21): a, c, g, u, unknown or other
guaaaccauucuugggaggnn

SEQ ID NO: 1894 - RNA, 21 nt, Artificial Sequence
  Description of Artificial Sequence: Synthetic oligonucleotide
  modified_base (20)..(21): a, c, g, u, unknown or other
uaaaccauucuugggaggann

SEQ ID NO: 1895 - RNA, 21 nt, Artificial Sequence
  Description of Artificial Sequence: Synthetic oligonucleotide
  modified_base (20)..(21): a, c, g, u, unknown or other
aaaccauucuugggaggacnn

SEQ ID NO: 1896 - RNA, 21 nt, Artificial Sequence
  Description of Artificial Sequence: Synthetic oligonucleotide
  modified_base (20)..(21): a, c, g, u, unknown or other
aaccauucuugggaggacann

SEQ ID NO: 1897 - RNA, 21 nt, Artificial Sequence
  Description of Artificial Sequence: Synthetic oligonucleotide
  modified_base (20)..(21): a, c, g, u, unknown or other
accauucuugggaggacacnn

SEQ ID NO: 1898 - RNA, 21 nt, Artificial Sequence
  Description of Artificial Sequence: Synthetic oligonucleotide
  modified_base (20)..(21): a, c, g, u, unknown or other
ccauucuugggaggacacunn

SEQ ID NO: 1899 - RNA, 21 nt, Artificial Sequence
  Description of Artificial Sequence: Synthetic oligonucleotide
  modified_base (20)..(21): a, c, g, u, unknown or other
cauucuugggaggacacuunn

SEQ ID NO: 1900 - RNA, 21 nt, Artificial Sequence
  Description of Artificial Sequence: Synthetic oligonucleotide
  modified_base (20)..(21): a, c, g, u, unknown or other
auucuugggaggacacuuunn

SEQ ID NO: 1901 - RNA, 21 nt, Artificial Sequence
  Description of Artificial Sequence: Synthetic oligonucleotide
  modified_base (20)..(21): a, c, g, u, unknown or other
uucuugggaggacacuuuunn

SEQ ID NO: 1902 - RNA, 21 nt, Artificial Sequence
  Description of Artificial Sequence: Synthetic oligonucleotide
  modified_base (20)..(21): a, c, g, u, unknown or other
cagcccgccuccgccgccgnn

SEQ ID NO: 1903 - RNA, 21 nt, Artificial Sequence
  Description of Artificial Sequence: Synthetic oligonucleotide
  modified_base (20)..(21): a, c, g, u, unknown or other
ucuugggaggacacuuuugnn

SEQ ID NO: 1904 - RNA, 21 nt, Artificial Sequence
  Description of Artificial Sequence: Synthetic oligonucleotide
  modified_base (20)..(21): a, c, g, u, unknown or other
cuugggaggacacuuuugcnn

SEQ ID NO: 1905 - RNA, 21 nt, Artificial Sequence
  Description of Artificial Sequence: Synthetic oligonucleotide
  modified_base (20)..(21): a, c, g, u, unknown or other
uugggaggacacuuuugccnn

SEQ ID NO: 1906 - RNA, 21 nt, Artificial Sequence
  Description of Artificial Sequence: Synthetic oligonucleotide
  modified_base (20)..(21): a, c, g, u, unknown or other
ugggaggacacuuuugccann

SEQ ID NO: 1907 - RNA, 21 nt, Artificial Sequence
  Description of Artificial Sequence: Synthetic oligonucleotide
  modified_base (20)..(21): a, c, g, u, unknown or other
gggaggacacuuuugccaann

SEQ ID NO: 1908 - RNA, 21 nt, Artificial Sequence
  Description of Artificial Sequence: Synthetic oligonucleotide
  modified_base (20)..(21): a, c, g, u, unknown or other
ggaggacacuuuugccaaunn

SEQ ID NO: 1909 - RNA, 21 nt, Artificial Sequence
  Description of Artificial Sequence: Synthetic oligonucleotide
  modified_base (20)..(21): a, c, g, u, unknown or other
gaggacacuuuugccaaugnn

SEQ ID NO: 1910 - RNA, 21 nt, Artificial Sequence
  Description of Artificial Sequence: Synthetic oligonucleotide
  modified_base (20)..(21): a, c, g, u, unknown or other
aggacacuuuugccaaugann

SEQ ID NO: 1911 - RNA, 21 nt, Artificial Sequence
  Description of Artificial Sequence: Synthetic oligonucleotide
  modified_base (20)..(21): a, c, g, u, unknown or other
ggacacuuuugccaaugaann

SEQ ID NO: 1912 - RNA, 21 nt, Artificial Sequence
  Description of Artificial Sequence: Synthetic oligonucleotide
  modified_base (20)..(21): a, c, g, u, unknown or other
gacacuuuugccaaugaacnn

SEQ ID NO: 1913 - RNA, 21 nt, Artificial Sequence
  Description of Artificial Sequence: Synthetic oligonucleotide
  modified_base (20)..(21): a, c, g, u, unknown or other
agcccgccuccgccgccggnn

SEQ ID NO: 1914 - RNA, 21 nt, Artificial Sequence
  Description of Artificial Sequence: Synthetic oligonucleotide
  modified_base (20)..(21): a, c, g, u, unknown or other
acacuuuugccaaugaacunn

SEQ ID NO: 1915 - RNA, 21 nt, Artificial Sequence
  Description of Artificial Sequence: Synthetic oligonucleotide
  modified_base (20)..(21): a, c, g, u, unknown or other
gcccgccuccgccgccggann

SEQ ID NO: 1916 - RNA, 21 nt, Artificial Sequence
  Description of Artificial Sequence: Synthetic oligonucleotide
  modified_base (20)..(21): a, c, g, u, unknown or other
cccgccuccgccgccggagnn

SEQ ID NO: 1917 - RNA, 21 nt, Artificial Sequence
  Description of Artificial Sequence: Synthetic oligonucleotide
  modified_base (20)..(21): a, c, g, u, unknown or other
uuuccccagcugauuagugnn

SEQ ID NO: 1918 - RNA, 21 nt, Artificial Sequence
  Description of Artificial Sequence: Synthetic oligonucleotide
  modified_base (20)..(21): a, c, g, u, unknown or other
uuccccagcugauuagugunn

SEQ ID NO: 1919 - RNA, 21 nt, Artificial Sequence
  Description of Artificial Sequence: Synthetic oligonucleotide
  modified_base (20)..(21): a, c, g, u, unknown or other
uccccagcugauuagugucnn

SEQ ID NO: 1920 - RNA, 21 nt, Artificial Sequence
  Description of Artificial Sequence: Synthetic oligonucleotide
  modified_base (20)..(21): a, c, g, u, unknown or other
ccccagcugauuagugucunn

SEQ ID NO: 1921 - RNA, 21 nt, Artificial Sequence
  Description of Artificial Sequence: Synthetic oligonucleotide
  modified_base (20)..(21): a, c, g, u, unknown or other
cccagcugauuagugucuann

SEQ ID NO: 1922 - RNA, 21 nt, Artificial Sequence
  Description of Artificial Sequence: Synthetic oligonucleotide
  modified_base (20)..(21): a, c, g, u, unknown or other
ccagcugauuagugucuaann

SEQ ID NO: 1923 - RNA, 21 nt, Artificial Sequence
  Description of Artificial Sequence: Synthetic oligonucleotide
  modified_base (20)..(21): a, c, g, u, unknown or other
cagcugauuagugucuaagnn

SEQ ID NO: 1924 - RNA, 21 nt, Artificial Sequence
  Description of Artificial Sequence: Synthetic oligonucleotide
  modified_base (20)..(21): a, c, g, u, unknown or other
agcugauuagugucuaaggnn

SEQ ID NO: 1925 - RNA, 21 nt, Artificial Sequence
  Description of Artificial Sequence: Synthetic oligonucleotide
  modified_base (20)..(21): a, c, g, u, unknown or other
gcugauuagugucuaaggann

SEQ ID NO: 1926 - RNA, 21 nt, Artificial Sequence
  Description of Artificial Sequence: Synthetic oligonucleotide
  modified_base (20)..(21): a, c, g, u, unknown or other
cugauuagugucuaaggaann

SEQ ID NO: 1927 - RNA, 21 nt, Artificial Sequence
  Description of Artificial Sequence: Synthetic oligonucleotide
  modified_base (20)..(21): a, c, g, u, unknown or other
ccgccuccgccgccggagcnn

SEQ ID NO: 1928 - RNA, 21 nt, Artificial Sequence
  Description of Artificial Sequence: Synthetic oligonucleotide
  modified_base (20)..(21): a, c, g, u, unknown or other
ugauuagugucuaaggaaunn

SEQ ID NO: 1929 - RNA, 21 nt, Artificial Sequence
  Description of Artificial Sequence: Synthetic oligonucleotide
  modified_base (20)..(21): a, c, g, u, unknown or other
gauuagugucuaaggaaugnn

SEQ ID NO: 1930 - RNA, 21 nt, Artificial Sequence
  Description of Artificial Sequence: Synthetic oligonucleotide
  modified_base (20)..(21): a, c, g, u, unknown or other
auuagugucuaaggaaugann

SEQ ID NO: 1931 - RNA, 21 nt, Artificial Sequence
  Description of Artificial Sequence: Synthetic oligonucleotide
  modified_base (20)..(21): a, c, g, u, unknown or other
uuagugucuaaggaaugaunn

SEQ ID NO: 1932 - RNA, 21 nt, Artificial Sequence
  Description of Artificial Sequence: Synthetic oligonucleotide
  modified_base (20)..(21): a, c, g, u, unknown or other
uagugucuaaggaaugaucnn

SEQ ID NO: 1933 - RNA, 21 nt, Artificial Sequence
  Description of Artificial Sequence: Synthetic oligonucleotide
  modified_base (20)..(21): a, c, g, u, unknown or other
agugucuaaggaaugauccnn

SEQ ID NO: 1934 - RNA, 21 nt, Artificial Sequence
  Description of Artificial Sequence: Synthetic oligonucleotide
  modified_base (20)..(21): a, c, g, u, unknown or other
gugucuaaggaaugauccann

SEQ ID NO: 1935 - RNA, 21 nt, Artificial Sequence
  Description of Artificial Sequence: Synthetic oligonucleotide
  modified_base (20)..(21): a, c, g, u, unknown or other
cgccuccgccgccggagccnn

SEQ ID NO: 1936 - RNA, 21 nt, Artificial Sequence
  Description of Artificial Sequence: Synthetic oligonucleotide
  modified_base (20)..(21): a, c, g, u, unknown or other
gccuccgccgccggagcccnn

SEQ ID NO: 1937 - RNA, 21 nt, Artificial Sequence
  Description of Artificial Sequence: Synthetic oligonucleotide
  modified_base (20)..(21): a, c, g, u, unknown or other
uacuguugcccuuuuccuunn

SEQ ID NO: 1938 - RNA, 21 nt, Artificial Sequence
  Description of Artificial Sequence: Synthetic oligonucleotide
  modified_base (20)..(21): a, c, g, u, unknown or other
acuguugcccuuuuccuugnn

SEQ ID NO: 1939 - RNA, 21 nt, Artificial Sequence
  Description of Artificial Sequence: Synthetic oligonucleotide
  modified_base (20)..(21): a, c, g, u, unknown or other
cuguugcccuuuuccuugann

SEQ ID NO: 1940 - RNA, 21 nt, Artificial Sequence
  Description of Artificial Sequence: Synthetic oligonucleotide
  modified_base (20)..(21): a, c, g, u, unknown or other
uguugcccuuuuccuugacnn

SEQ ID NO: 1941 - RNA, 21 nt, Artificial Sequence
  Description of Artificial Sequence: Synthetic oligonucleotide
  modified_base (20)..(21): a, c, g, u, unknown or other
ccuccgccgccggagccccnn

SEQ ID NO: 1942 - RNA, 21 nt, Artificial Sequence
  Description of Artificial Sequence: Synthetic oligonucleotide
  modified_base (20)..(21): a, c, g, u, unknown or other
guugcccuuuuccuugacunn

SEQ ID NO: 1943 - RNA, 21 nt, Artificial Sequence
  Description of Artificial Sequence: Synthetic oligonucleotide
  modified_base (20)..(21): a, c, g, u, unknown or other
uugcccuuuuccuugacuann

SEQ ID NO: 1944 - RNA, 21 nt, Artificial Sequence
  Description of Artificial Sequence: Synthetic oligonucleotide
  modified_base (20)..(21): a, c, g, u, unknown or other
ugcccuuuuccuugacuaunn

SEQ ID NO: 1945 - RNA, 21 nt, Artificial Sequence
  Description of Artificial Sequence: Synthetic oligonucleotide
  modified_base (20)..(21): a, c, g, u, unknown or other
gcccuuuuccuugacuauunn

SEQ ID NO: 1946 - RNA, 21 nt, Artificial Sequence
  Description of Artificial Sequence: Synthetic oligonucleotide
  modified_base (20)..(21): a, c, g, u, unknown or other
cccuuuuccuugacuauuann

SEQ ID NO: 1947 - RNA, 21 nt, Artificial Sequence
  Description of Artificial Sequence: Synthetic oligonucleotide
  modified_base (20)..(21): a, c, g, u, unknown or other
ccuuuuccuugacuauuacnn

SEQ ID NO: 1948 - RNA, 21 nt, Artificial Sequence
  Description of Artificial Sequence: Synthetic oligonucleotide
  modified_base (20)..(21): a, c, g, u, unknown or other
cuuuuccuugacuauuacann

SEQ ID NO: 1949 - RNA, 21 nt, Artificial Sequence
  Description of Artificial Sequence: Synthetic oligonucleotide
  modified_base (20)..(21): a, c, g, u, unknown or other
uuuuccuugacuauuacacnn

SEQ ID NO: 1950 - RNA, 21 nt, Artificial Sequence
  Description of Artificial Sequence: Synthetic oligonucleotide
  modified_base (20)..(21): a, c, g, u, unknown or other
uuuccuugacuauuacacunn

SEQ ID NO: 1951 - RNA, 21 nt, Artificial Sequence
  Description of Artificial Sequence: Synthetic oligonucleotide
  modified_base (20)..(21): a, c, g, u, unknown or other
uuccuugacuauuacacugnn

SEQ ID NO: 1952 - RNA, 21 nt, Artificial Sequence
  Description of Artificial Sequence: Synthetic oligonucleotide
  modified_base (20)..(21): a, c, g, u, unknown or other
cuccgccgccggagccccgnn

SEQ ID NO: 1953 - RNA, 21 nt, Artificial Sequence
  Description of Artificial Sequence: Synthetic oligonucleotide
  modified_base (20)..(21): a, c, g, u, unknown or other
uccuugacuauuacacugcnn

SEQ ID NO: 1954 - RNA, 21 nt, Artificial Sequence
  Description of Artificial Sequence: Synthetic oligonucleotide
  modified_base (20)..(21): a, c, g, u, unknown or other
ccuugacuauuacacugccnn

SEQ ID NO: 1955 - RNA, 21 nt, Artificial Sequence
  Description of Artificial Sequence: Synthetic oligonucleotide
  modified_base (20)..(21): a, c, g, u, unknown or other
cuugacuauuacacugccunn

SEQ ID NO: 1956 - RNA, 21 nt, Artificial Sequence
  Description of Artificial Sequence: Synthetic oligonucleotide
  modified_base (20)..(21): a, c, g, u, unknown or other
uugacuauuacacugccugnn

SEQ ID NO: 1957 - RNA, 21 nt, Artificial Sequence
  Description of Artificial Sequence: Synthetic oligonucleotide
  modified_base (20)..(21): a, c, g, u, unknown or other
ugacuauuacacugccuggnn

SEQ ID NO: 1958 - RNA, 21 nt, Artificial Sequence
  Description of Artificial Sequence: Synthetic oligonucleotide
  modified_base (20)..(21): a, c, g, u, unknown or other
gacuauuacacugccuggann

SEQ ID NO: 1959 - RNA, 21 nt, Artificial Sequence
  Description of Artificial Sequence: Synthetic oligonucleotide
  modified_base (20)..(21): a, c, g, u, unknown or other
acuauuacacugccuggagnn

SEQ ID NO: 1960 - RNA, 21 nt, Artificial Sequence
  Description of Artificial Sequence: Synthetic oligonucleotide
  modified_base (20)..(21): a, c, g, u, unknown or other
cuauuacacugccuggaggnn

SEQ ID NO: 1961 - RNA, 21 nt, Artificial Sequence
  Description of Artificial Sequence: Synthetic oligonucleotide
  modified_base (20)..(21): a, c, g, u, unknown or other
uauuacacugccuggaggann

SEQ ID NO: 1962 - RNA, 21 nt, Artificial Sequence
  Description of Artificial Sequence: Synthetic oligonucleotide
  modified_base (20)..(21): a, c, g, u, unknown or other
auuacacugccuggaggaunn

SEQ ID NO: 1963 - RNA, 21 nt, Artificial Sequence
  Description of Artificial Sequence: Synthetic oligonucleotide
  modified_base (20)..(21): a, c, g, u, unknown or other
uccgccgccggagccccggnn

SEQ ID NO: 1964 - RNA, 21 nt, Artificial Sequence
  Description of Artificial Sequence: Synthetic oligonucleotide
  modified_base (20)..(21): a, c, g, u, unknown or other
uuacacugccuggaggauann

SEQ ID NO: 1965 - RNA, 21 nt, Artificial Sequence
  Description of Artificial Sequence: Synthetic oligonucleotide
  modified_base (20)..(21): a, c, g, u, unknown or other
uacacugccuggaggauagnn

SEQ ID NO: 1966 - RNA, 21 nt, Artificial Sequence
  Description of Artificial Sequence: Synthetic oligonucleotide
  modified_base (20)..(21): a, c, g, u, unknown or other
acacugccuggaggauagcnn

SEQ ID NO: 1967 - RNA, 21 nt, Artificial Sequence
  Description of Artificial Sequence: Synthetic oligonucleotide
  modified_base (20)..(21): a, c, g, u, unknown or other
cacugccuggaggauagcann

SEQ ID NO: 1968 - RNA, 21 nt, Artificial Sequence
  Description of Artificial Sequence: Synthetic oligonucleotide
  modified_base (20)..(21): a, c, g, u, unknown or other
acugccuggaggauagcagnn

SEQ ID NO: 1969 - RNA, 21 nt, Artificial Sequence
  Description of Artificial Sequence: Synthetic oligonucleotide
  modified_base (20)..(21): a, c, g, u, unknown or other
ccgccgccggagccccggcnn

SEQ ID NO: 1970 - RNA, 21 nt, Artificial Sequence
  Description of Artificial Sequence: Synthetic oligonucleotide
  modified_base (20)..(21): a, c, g, u, unknown or other
cgccgccggagccccggccnn

SEQ ID NO: 1971 - DNA, 21 bp, Artificial Sequence
  Description of Artificial Sequence: Synthetic oligonucleotide
  modified_base (20)..(21): a, c, g, u, unknown or other
gccgccggagccccggccgnn

SEQ ID NO: 1972 - DNA, 21 bp, Artificial Sequence
  Description of Artificial Sequence: Synthetic oligonucleotide
  modified_base (20)..(21): a, c, g, u, unknown or other
cuucauucaaaaagccaaann

SEQ ID NO: 1973 - RNA, 21 nt, Artificial Sequence
  Description of Artificial Sequence: Synthetic oligonucleotide
  modified_base (20)..(21): a, c, g, u, unknown or other
uucauucaaaaagccaaaann

SEQ ID NO: 1974 - RNA, 21 nt, Artificial Sequence
  Description of Artificial Sequence: Synthetic oligonucleotide
  modified_base (20)..(21): a, c, g, u, unknown or other
ccgccggagccccggccggnn

SEQ ID NO: 1975 - RNA, 21 nt, Artificial Sequence
  Description of Artificial Sequence: Synthetic oligonucleotide
  modified_base (20)..(21): a, c, g, u, unknown or other
ucauucaaaaagccaaaaunn

SEQ ID NO: 1976 - RNA, 21 nt, Artificial Sequence
  Description of Artificial Sequence: Synthetic oligonucleotide
  modified_base (20)..(21): a, c, g, u, unknown or other
cauucaaaaagccaaaauann

SEQ ID NO: 1977 - RNA, 21 nt, Artificial Sequence
  Description of Artificial Sequence: Synthetic oligonucleotide
  modified_base (20)..(21): a, c, g, u, unknown or other
auucaaaaagccaaaauagnn

SEQ ID NO: 1978 - RNA, 21 nt, Artificial Sequence
  Description of Artificial Sequence: Synthetic oligonucleotide
  modified_base (20)..(21): a, c, g, u, unknown or other
uucaaaaagccaaaauagann

SEQ ID NO: 1979 - RNA, 21 nt, Artificial Sequence
  Description of Artificial Sequence: Synthetic oligonucleotide
  modified_base (20)..(21): a, c, g, u, unknown or other
ucaaaaagccaaaauagagnn

SEQ ID NO: 1980 - RNA, 21 nt, Artificial Sequence
  Description of Artificial Sequence: Synthetic oligonucleotide
  modified_base (20)..(21): a, c, g, u, unknown or other
caaaaagccaaaauagagann

SEQ ID NO: 1981 - RNA, 21 nt, Artificial Sequence
  Description of Artificial Sequence: Synthetic oligonucleotide
  modified_base (20)..(21): a, c, g, u, unknown or other
aaaaagccaaaauagagagnn

SEQ ID NO: 1982 - RNA, 21 nt, Artificial Sequence
  Description of Artificial Sequence: Synthetic oligonucleotide
  modified_base (20)..(21): a, c, g, u, unknown or other
aaaagccaaaauagagagunn

SEQ ID NO: 1983 - RNA, 21 nt, Artificial Sequence
  Description of Artificial Sequence: Synthetic oligonucleotide
  modified_base (20)..(21): a, c, g, u, unknown or other
aaagccaaaauagagaguann

SEQ ID NO: 1984 - RNA, 21 nt, Artificial Sequence
  Description of Artificial Sequence: Synthetic oligonucleotide
  modified_base (20)..(21): a, c, g, u, unknown or other
cgccggagccccggccggcnn

SEQ ID NO: 1985 - RNA, 21 nt, Artificial Sequence
  Description of Artificial Sequence: Synthetic oligonucleotide
  modified_base (20)..(21): a, c, g, u, unknown or other
gccggagccccggccggccnn

SEQ ID NO: 1986 - DNA, 21 bp, Artificial Sequence
  Description of Artificial Sequence: Synthetic oligonucleotide
  modified_base (20)..(21): a, c, g, u, unknown or other
acaguccuagagaauuccunn

SEQ ID NO: 1987 - RNA, 21 nt, Artificial Sequence
  Description of Artificial Sequence: Synthetic oligonucleotide
  modified_base (20)..(21): a, c, g, u, unknown or other
ccggagccccggccggccann

SEQ ID NO: 1988 - RNA, 21 nt, Artificial Sequence
  Description of Artificial Sequence: Synthetic oligonucleotide
  modified_base (20)..(21): a, c, g, u, unknown or other
cggagccccggccggccagnn

SEQ ID NO: 1989 - DNA, 21 bp, Artificial Sequence
  Description of Artificial Sequence: Synthetic oligonucleotide
  modified_base (20)..(21): a, c, g, u, unknown or other
uauuuguucagaucucauann

SEQ ID NO: 1990 - RNA, 21 nt, Artificial Sequence
  Description of Artificial Sequence: Synthetic oligonucleotide
  modified_base (20)..(21): a, c, g, u, unknown or other
auuuguucagaucucauagnn

SEQ ID NO: 1991 - RNA, 21 nt, Artificial Sequence
  Description of Artificial Sequence: Synthetic oligonucleotide
  modified_base (20)..(21): a, c, g, u, unknown or other
ggagccccggccggccaggnn

SEQ ID NO: 1992 - RNA, 21 nt, Artificial Sequence
  Description of Artificial Sequence: Synthetic oligonucleotide
  modified_base (20)..(21): a, c, g, u, unknown or other
uuuguucagaucucauagann

SEQ ID NO: 1993 - RNA, 21 nt, Artificial Sequence
  Description of Artificial Sequence: Synthetic oligonucleotide
  modified_base (20)..(21): a, c, g, u, unknown or other
uuguucagaucucauagaunn

SEQ ID NO: 1994 - RNA, 21 nt, Artificial Sequence
  Description of Artificial Sequence: Synthetic oligonucleotide
  modified_base (20)..(21): a, c, g, u, unknown or other
uguucagaucucauagaugnn

SEQ ID NO: 1995 - RNA, 21 nt, Artificial Sequence
  Description of Artificial Sequence: Synthetic oligonucleotide
  modified_base (20)..(21): a, c, g, u, unknown or other
guucagaucucauagaugann

SEQ ID NO: 1996 - RNA, 21 nt, Artificial Sequence
  Description of Artificial Sequence: Synthetic oligonucleotide
  modified_base (20)..(21): a, c, g, u, unknown or other
gagccccggccggccaggcnn

SEQ ID NO: 1997 - RNA, 21 nt, Artificial Sequence
  Description of Artificial Sequence: Synthetic oligonucleotide
  modified_base (20)..(21): a, c, g, u, unknown or other
agccccggccggccaggccnn

SEQ ID NO: 1998 - DNA, 21 bp, Artificial Sequence
  Description of Artificial Sequence: Synthetic oligonucleotide
  modified_base (20)..(21): a, c, g, u, unknown or other
gccccggccggccaggcccnn

SEQ ID NO: 1999 - DNA, 21 bp, Artificial Sequence
  Description of Artificial Sequence: Synthetic oligonucleotide
  modified_base (20)..(21): a, c, g, u, unknown or other
ugucuuuugacauccagcann

SEQ ID NO: 2000 - RNA, 21 nt, Artificial Sequence
  Description of Artificial Sequence: Synthetic oligonucleotide
  modified_base (20)..(21): a, c, g, u, unknown or other
gucuuuugacauccagcagnn

SEQ ID NO: 2001 - RNA, 21 nt, Artificial Sequence
  Description of Artificial Sequence: Synthetic oligonucleotide
  modified_base (20)..(21): a, c, g, u, unknown or other
ucuuuugacauccagcagunn

SEQ ID NO: 2002 - RNA, 21 nt, Artificial Sequence
  Description of Artificial Sequence: Synthetic oligonucleotide
  modified_base (20)..(21): a, c, g, u, unknown or other
cuuuugacauccagcagucnn

SEQ ID NO: 2003 - RNA, 21 nt, Artificial Sequence
  Description of Artificial Sequence: Synthetic oligonucleotide
  modified_base (20)..(21): a, c, g, u, unknown or other
uuuugacauccagcaguccnn

SEQ ID NO: 2004 - RNA, 21 nt, Artificial Sequence
  Description of Artificial Sequence: Synthetic oligonucleotide
  modified_base (20)..(21): a, c, g, u, unknown or other
uuugacauccagcaguccann

SEQ ID NO: 2005 - RNA, 21 nt, Artificial Sequence
  Description of Artificial Sequence: Synthetic oligonucleotide
  modified_base (20)..(21): a, c, g, u, unknown or other
uugacauccagcaguccaann

SEQ ID NO: 2006 - RNA, 21 nt, Artificial Sequence
  Description of Artificial Sequence: Synthetic oligonucleotide
  modified_base (20)..(21): a, c, g, u, unknown or other
ccccggccggccaggcccunn

SEQ ID NO: 2007 - RNA, 21 nt, Artificial Sequence
  Description of Artificial Sequence: Synthetic oligonucleotide
  modified_base (20)..(21): a, c, g, u, unknown or other
cccggccggccaggcccugnn

SEQ ID NO: 2008 - RNA, 21 nt, Artificial Sequence
  Description of Artificial Sequence: Synthetic oligonucleotide
  modified_base (20)..(21): a, c, g, u, unknown or other
guauugagacauauuacugnn

SEQ ID NO: 2009 - RNA, 21 nt, Artificial Sequence
  Description of Artificial Sequence: Synthetic oligonucleotide
  modified_base (20)..(21): a, c, g, u, unknown or other
ccggccggccaggcccugcnn

SEQ ID NO: 2010 - RNA, 21 nt, Artificial Sequence
  Description of Artificial Sequence: Synthetic oligonucleotide
  modified_base (20)..(21): a, c, g, u, unknown or other
cggccggccaggcccugccnn

SEQ ID NO: 2011 - RNA, 21 nt, Artificial Sequence
  Description of Artificial Sequence: Synthetic oligonucleotide
  modified_base (20)..(21): a, c, g, u, unknown or other
ggccggccaggcccugccgnn

SEQ ID NO: 2012 - RNA, 21 nt, Artificial Sequence
  Description of Artificial Sequence: Synthetic oligonucleotide
  modified_base (20)..(21): a, c, g, u, unknown or other
uaagaaauauuacuauaaunn

SEQ ID NO: 2013 - RNA, 21 nt, Artificial Sequence
  Description of Artificial Sequence: Synthetic oligonucleotide
  modified_base (20)..(21): a, c, g, u, unknown or other
aagaaauauuacuauaauunn

SEQ ID NO: 2014 - RNA, 21 nt, Artificial Sequence
  Description of Artificial Sequence: Synthetic oligonucleotide
  modified_base (20)..(21): a, c, g, u, unknown or other
agaaauauuacuauaauugnn

SEQ ID NO: 2015 - RNA, 21 nt, Artificial Sequence
  Description of Artificial Sequence: Synthetic oligonucleotide
  modified_base (20)..(21): a, c, g, u, unknown or other
gaaauauuacuauaauugann

SEQ ID NO: 2016 - RNA, 21 nt, Artificial Sequence
  Description of Artificial Sequence: Synthetic oligonucleotide
  modified_base (20)..(21): a, c, g, u, unknown or other
aaauauuacuauaauugagnn

SEQ ID NO: 2017 - RNA, 21 nt, Artificial Sequence
  Description of Artificial Sequence: Synthetic oligonucleotide
  modified_base (20)..(21): a, c, g, u, unknown or other
aauauuacuauaauugagann

SEQ ID NO: 2018 - RNA, 21 nt, Artificial Sequence
  Description of Artificial Sequence: Synthetic oligonucleotide
  modified_base (20)..(21): a, c, g, u, unknown or other
auauuacuauaauugagaann

SEQ ID NO: 2019 - RNA, 21 nt, Artificial Sequence
  Description of Artificial Sequence: Synthetic oligonucleotide
  modified_base (20)..(21): a, c, g, u, unknown or other
uauuacuauaauugagaacnn

SEQ ID NO: 2020 - RNA, 21 nt, Artificial Sequence
  Description of Artificial Sequence: Synthetic oligonucleotide
  modified_base (20)..(21): a, c, g, u, unknown or other
gccggccaggcccugccgcnn

SEQ ID NO: 2021 - RNA, 21 nt, Artificial Sequence
  Description of Artificial Sequence: Synthetic oligonucleotide
  modified_base (20)..(21): a, c, g, u, unknown or other
auuacuauaauugagaacunn

SEQ ID NO: 2022 - RNA, 21 nt, Artificial Sequence
  Description of Artificial Sequence: Synthetic oligonucleotide
  modified_base (20)..(21): a, c, g, u, unknown or other
uuacuauaauugagaacuann

SEQ ID NO: 2023 - RNA, 21 nt, Artificial Sequence
  Description of Artificial Sequence: Synthetic oligonucleotide
  modified_base (20)..(21): a, c, g, u, unknown or other
uacuauaauugagaacuacnn

SEQ ID NO: 2024 - RNA, 21 nt, Artificial Sequence
  Description of Artificial Sequence: Synthetic oligonucleotide
  modified_base (20)..(21): a, c, g, u, unknown or other
acuauaauugagaacuacann

SEQ ID NO: 2025 - RNA, 21 nt, Artificial Sequence
  Description of Artificial Sequence: Synthetic oligonucleotide
  modified_base (20)..(21): a, c, g, u, unknown or other
cuauaauugagaacuacagnn

SEQ ID NO: 2026 - RNA, 21 nt, Artificial Sequence
  Description of Artificial Sequence: Synthetic oligonucleotide
  modified_base (20)..(21): a, c, g, u, unknown or other
uauaauugagaacuacagcnn

SEQ ID NO: 2027 - RNA, 21 nt, Artificial Sequence
  Description of Artificial Sequence: Synthetic oligonucleotide
  modified_base (20)..(21): a, c, g, u, unknown or other
auaauugagaacuacagcunn

SEQ ID NO: 2028 - RNA, 21 nt, Artificial Sequence
  Description of Artificial Sequence: Synthetic oligonucleotide
  modified_base (20)..(21): a, c, g, u, unknown or other
uaauugagaacuacagcuunn

SEQ ID NO: 2029 - RNA, 21 nt, Artificial Sequence
  Description of Artificial Sequence: Synthetic oligonucleotide
  modified_base (20)..(21): a, c, g, u, unknown or other
aauugagaacuacagcuuunn

SEQ ID NO: 2030 - RNA, 21 nt, Artificial Sequence
  Description of Artificial Sequence: Synthetic oligonucleotide
  modified_base (20)..(21): a, c, g, u, unknown or other
auugagaacuacagcuuuunn

SEQ ID NO: 2031 - RNA, 21 nt, Artificial Sequence
  Description of Artificial Sequence: Synthetic oligonucleotide
  modified_base (20)..(21): a, c, g, u, unknown or other
ccggccaggcccugccgcunn

SEQ ID NO: 2032 - RNA, 21 nt, Artificial Sequence
  Description of Artificial Sequence: Synthetic oligonucleotide
  modified_base (20)..(21): a, c, g, u, unknown or other
uugagaacuacagcuuuuann

SEQ ID NO: 2033 - RNA, 21 nt, Artificial Sequence
  Description of Artificial Sequence: Synthetic oligonucleotide
  modified_base (20)..(21): a, c, g, u, unknown or other
ugagaacuacagcuuuuaann

SEQ ID NO: 2034 - RNA, 21 nt, Artificial Sequence
  Description of Artificial Sequence: Synthetic oligonucleotide
  modified_base (20)..(21): a, c, g, u, unknown or other
gagaacuacagcuuuuaagnn

SEQ ID NO: 2035 - RNA, 21 nt, Artificial Sequence
  Description of Artificial Sequence: Synthetic oligonucleotide
  modified_base (20)..(21): a, c, g, u, unknown or other
agaacuacagcuuuuaagann

SEQ ID NO: 2036 - RNA, 21 nt, Artificial Sequence
  Description of Artificial Sequence: Synthetic oligonucleotide
  modified_base (20)..(21): a, c, g, u, unknown or other
gaacuacagcuuuuaagaunn

SEQ ID NO: 2037 - RNA, 21 nt, Artificial Sequence
  Description of Artificial Sequence: Synthetic oligonucleotide
  modified_base (20)..(21): a, c, g, u, unknown or other
aacuacagcuuuuaagauunn

SEQ ID NO: 2038 - RNA, 21 nt, Artificial Sequence
  Description of Artificial Sequence: Synthetic oligonucleotide
  modified_base (20)..(21): a, c, g, u, unknown or other
acuacagcuuuuaagauugnn

SEQ ID NO: 2039 - RNA, 21 nt, Artificial Sequence
  Description of Artificial Sequence: Synthetic oligonucleotide
  modified_base (20)..(21): a, c, g, u, unknown or other
cuacagcuuuuaagauugunn

SEQ ID NO: 2040 - RNA, 21 nt, Artificial Sequence
  Description of Artificial Sequence: Synthetic oligonucleotide
  modified_base (20)..(21): a, c, g, u, unknown or other
uacagcuuuuaagauuguann

SEQ ID NO: 2041 - RNA, 21 nt, Artificial Sequence
  Description of Artificial Sequence: Synthetic oligonucleotide
  modified_base (20)..(21): a, c, g, u, unknown or other
acagcuuuuaagauuguacnn

SEQ ID NO: 2042 - RNA, 21 nt, Artificial Sequence
  Description of Artificial Sequence: Synthetic oligonucleotide
  modified_base (20)..(21): a, c, g, u, unknown or other
cggccaggcccugccgcucnn

SEQ ID NO: 2043 - RNA, 21 nt, Artificial Sequence
  Description of Artificial Sequence: Synthetic oligonucleotide
  modified_base (20)..(21): a, c, g, u, unknown or other
cagcuuuuaagauuguacunn

SEQ ID NO: 2044 - RNA, 21 nt, Artificial Sequence
  Description of Artificial Sequence: Synthetic oligonucleotide
  modified_base (20)..(21): a, c, g, u, unknown or other
agcuuuuaagauuguacuunn

SEQ ID NO: 2045 - RNA, 21 nt, Artificial Sequence
  Description of Artificial Sequence: Synthetic oligonucleotide
  modified_base (20)..(21): a, c, g, u, unknown or other
gcuuuuaagauuguacuuunn

SEQ ID NO: 2046 - RNA, 21 nt, Artificial Sequence
  Description of Artificial Sequence: Synthetic oligonucleotide
  modified_base (20)..(21): a, c, g, u, unknown or other
cuuuuaagauuguacuuuunn

SEQ ID NO: 2047 - RNA, 21 nt, Artificial Sequence
  Description of Artificial Sequence: Synthetic oligonucleotide
  modified_base (20)..(21): a, c, g, u, unknown or other
uuuuaagauuguacuuuuann

SEQ ID NO: 2048 - RNA, 21 nt, Artificial Sequence
  Description of Artificial Sequence: Synthetic oligonucleotide
  modified_base (20)..(21): a, c, g, u, unknown or other
uuuaagauuguacuuuuaunn

SEQ ID NO: 2049 - RNA, 21 nt, Artificial Sequence
  Description of Artificial Sequence: Synthetic oligonucleotide
  modified_base (20)..(21): a, c, g, u, unknown or other
uuaagauuguacuuuuaucnn

SEQ ID NO: 2050 - RNA, 21 nt, Artificial Sequence
  Description of Artificial Sequence: Synthetic oligonucleotide
  modified_base (20)..(21): a, c, g, u, unknown or other
uaagauuguacuuuuaucunn

SEQ ID NO: 2051 - RNA, 21 nt, Artificial Sequence
  Description of Artificial Sequence: Synthetic oligonucleotide
  modified_base (20)..(21): a, c, g, u, unknown or other
aagauuguacuuuuaucuunn

SEQ ID NO: 2052 - RNA, 21 nt, Artificial Sequence
  Description of Artificial Sequence: Synthetic oligonucleotide
  modified_base (20)..(21): a, c, g, u, unknown or other
agauuguacuuuuaucuuann

SEQ ID NO: 2053 - RNA, 21 nt, Artificial Sequence
  Description of Artificial Sequence: Synthetic oligonucleotide
  modified_base (20)..(21): a, c, g, u, unknown or other
ggccaggcccugccgcucann

SEQ ID NO: 2054 - RNA, 21 nt, Artificial Sequence
  Description of Artificial Sequence: Synthetic oligonucleotide
  modified_base (20)..(21): a, c, g, u, unknown or other
gauuguacuuuuaucuuaann

SEQ ID NO: 2055 - RNA, 21 nt, Artificial Sequence
  Description of Artificial Sequence: Synthetic oligonucleotide
  modified_base (20)..(21): a, c, g, u, unknown or other
auuguacuuuuaucuuaaann

SEQ ID NO: 2056 - RNA, 21 nt, Artificial Sequence
  Description of Artificial Sequence: Synthetic oligonucleotide
  modified_base (20)..(21): a, c, g, u, unknown or other
uuguacuuuuaucuuaaaann

SEQ ID NO: 2057 - RNA, 21 nt, Artificial Sequence
  Description of Artificial Sequence: Synthetic oligonucleotide
  modified_base (20)..(21): a, c, g, u, unknown or other
uguacuuuuaucuuaaaagnn

SEQ ID NO: 2058 - RNA, 21 nt, Artificial Sequence
  Description of Artificial Sequence: Synthetic oligonucleotide
  modified_base (20)..(21): a, c, g, u, unknown or other
guacuuuuaucuuaaaaggnn

SEQ ID NO: 2059 - RNA, 21 nt, Artificial Sequence
  Description of Artificial Sequence: Synthetic oligonucleotide
  modified_base (20)..(21): a, c, g, u, unknown or other
uacuuuuaucuuaaaagggnn

SEQ ID NO: 2060 - RNA, 21 nt, Artificial Sequence
  Description of Artificial Sequence: Synthetic oligonucleotide
  modified_base (20)..(21): a, c, g, u, unknown or other
acuuuuaucuuaaaagggunn

SEQ ID NO: 2061 - RNA, 21 nt, Artificial Sequence
  Description of Artificial Sequence: Synthetic oligonucleotide
  modified_base (20)..(21): a, c, g, u, unknown or other
cuuuuaucuuaaaagggugnn

SEQ ID NO: 2062 - RNA, 21 nt, Artificial Sequence
  Description of Artificial Sequence: Synthetic oligonucleotide
  modified_base (20)..(21): a, c, g, u, unknown or other
uuuuaucuuaaaaggguggnn

SEQ ID NO: 2063 - RNA, 21 nt, Artificial Sequence
  Description of Artificial Sequence: Synthetic oligonucleotide
  modified_base (20)..(21): a, c, g, u, unknown or other
uuuaucuuaaaaggguggunn

SEQ ID NO: 2064 - RNA, 21 nt, Artificial Sequence
  Description of Artificial Sequence: Synthetic oligonucleotide
  modified_base (20)..(21): a, c, g, u, unknown or other
gccaggcccugccgcucaunn

SEQ ID NO: 2065 - RNA, 21 nt, Artificial Sequence
  Description of Artificial Sequence: Synthetic oligonucleotide
  modified_base (20)..(21): a, c, g, u, unknown or other
uuaucuuaaaagggugguann

SEQ ID NO: 2066 - RNA, 21 nt, Artificial Sequence
  Description of Artificial Sequence: Synthetic oligonucleotide
  modified_base (20)..(21): a, c, g, u, unknown or other
uaucuuaaaagggugguagnn

SEQ ID NO: 2067 - RNA, 21 nt, Artificial Sequence
  Description of Artificial Sequence: Synthetic oligonucleotide
  modified_base (20)..(21): a, c, g, u, unknown or other
aucuuaaaagggugguagunn

SEQ ID NO: 2068 - RNA, 21 nt, Artificial Sequence
  Description of Artificial Sequence: Synthetic oligonucleotide
  modified_base (20)..(21): a, c, g, u, unknown or other
ucuuaaaagggugguaguunn

SEQ ID NO: 2069 - RNA, 21 nt, Artificial Sequence
  Description of Artificial Sequence: Synthetic oligonucleotide
  modified_base (20)..(21): a, c, g, u, unknown or other
cuuaaaagggugguaguuunn

SEQ ID NO: 2070 - RNA, 21 nt, Artificial Sequence
  Description of Artificial Sequence: Synthetic oligonucleotide
  modified_base (20)..(21): a, c, g, u, unknown or other
ccaggcccugccgcucaugnn

SEQ ID NO: 2071 - RNA, 21 nt, Artificial Sequence
  Description of Artificial Sequence: Synthetic oligonucleotide
  modified_base (20)..(21): a, c, g, u, unknown or other
caggcccugccgcucauggnn

SEQ ID NO: 2072 - RNA, 21 nt, Artificial Sequence
  Description of Artificial Sequence: Synthetic oligonucleotide
  modified_base (20)..(21): a, c, g, u, unknown or other
cccuaaaauacuuauuaugnn

SEQ ID NO: 2073 - RNA, 21 nt, Artificial Sequence
  Description of Artificial Sequence: Synthetic oligonucleotide
  modified_base (20)..(21): a, c, g, u, unknown or other
ccuaaaauacuuauuaugunn

SEQ ID NO: 2074 - RNA, 21 nt, Artificial Sequence
  Description of Artificial Sequence: Synthetic oligonucleotide
  modified_base (20)..(21): a, c, g, u, unknown or other
cuaaaauacuuauuauguann

SEQ ID NO: 2075 - RNA, 21 nt, Artificial Sequence
  Description of Artificial Sequence: Synthetic oligonucleotide
  modified_base (20)..(21): a, c, g, u, unknown or other
uaaaauacuuauuauguaann

SEQ ID NO: 2076 - RNA, 21 nt, Artificial Sequence
  Description of Artificial Sequence: Synthetic oligonucleotide
  modified_base (20)..(21): a, c, g, u, unknown or other
aaaauacuuauuauguaagnn

SEQ ID NO: 2077 - RNA, 21 nt, Artificial Sequence
  Description of Artificial Sequence: Synthetic oligonucleotide
  modified_base (20)..(21): a, c, g, u, unknown or other
aaauacuuauuauguaaggnn

SEQ ID NO: 2078 - RNA, 21 nt, Artificial Sequence
  Description of Artificial Sequence: Synthetic oligonucleotide
  modified_base (20)..(21): a, c, g, u, unknown or other
aggcccugccgcucauggunn

SEQ ID NO: 2079 - RNA, 21 nt, Artificial Sequence
  Description of Artificial Sequence: Synthetic oligonucleotide
  modified_base (20)..(21): a, c, g, u, unknown or other
aauacuuauuauguaagggnn

SEQ ID NO: 2080 - RNA, 21 nt, Artificial Sequence
  Description of Artificial Sequence: Synthetic oligonucleotide
  modified_base (20)..(21): a, c, g, u, unknown or other
auacuuauuauguaagggunn

SEQ ID NO: 2081 - RNA, 21 nt, Artificial Sequence
  Description of Artificial Sequence: Synthetic oligonucleotide
  modified_base (20)..(21): a, c, g, u, unknown or other
uacuuauuauguaagggucnn

SEQ ID NO: 2082 - RNA, 21 nt, Artificial Sequence
  Description of Artificial Sequence: Synthetic oligonucleotide
  modified_base (20)..(21): a, c, g, u, unknown or other
acuuauuauguaagggucann

SEQ ID NO: 2083 - RNA, 21 nt, Artificial Sequence
  Description of Artificial Sequence: Synthetic oligonucleotide
  modified_base (20)..(21): a, c, g, u, unknown or other
cuuauuauguaagggucaunn

SEQ ID NO: 2084 - RNA, 21 nt, Artificial Sequence
  Description of Artificial Sequence: Synthetic oligonucleotide
  modified_base (20)..(21): a, c, g, u, unknown or other
uuauuauguaagggucauunn

SEQ ID NO: 2085 - RNA, 21 nt, Artificial Sequence
  Description of Artificial Sequence: Synthetic oligonucleotide
  modified_base (20)..(21): a, c, g, u, unknown or other
uauuauguaagggucauuann

SEQ ID NO: 2086 - RNA, 21 nt, Artificial Sequence
  Description of Artificial Sequence: Synthetic oligonucleotide
  modified_base (20)..(21): a, c, g, u, unknown or other
auuauguaagggucauuagnn

SEQ ID NO: 2087 - RNA, 21 nt, Artificial Sequence
  Description of Artificial Sequence: Synthetic oligonucleotide
  modified_base (20)..(21): a, c, g, u, unknown or other
uuauguaagggucauuagann

SEQ ID NO: 2088 - RNA, 21 nt, Artificial Sequence
  Description of Artificial Sequence: Synthetic oligonucleotide
  modified_base (20)..(21): a, c, g, u, unknown or other
uauguaagggucauuagacnn

SEQ ID NO: 2089 - RNA, 21 nt, Artificial Sequence
  Description of Artificial Sequence: Synthetic oligonucleotide
  modified_base (20)..(21): a, c, g, u, unknown or other
ggcccugccgcucauggugnn

SEQ ID NO: 2090 - RNA, 21 nt, Artificial Sequence
  Description of Artificial Sequence: Synthetic oligonucleotide
  modified_base (20)..(21): a, c, g, u, unknown or other
auguaagggucauuagacann

SEQ ID NO: 2091 - RNA, 21 nt, Artificial Sequence
  Description of Artificial Sequence: Synthetic oligonucleotide
  modified_base (20)..(21): a, c, g, u, unknown or other
uguaagggucauuagacaann

SEQ ID NO: 2092 - RNA, 21 nt, Artificial Sequence
  Description of Artificial Sequence: Synthetic oligonucleotide
  modified_base (20)..(21): a, c, g, u, unknown or other
guaagggucauuagacaaann

SEQ ID NO: 2093 - RNA, 21 nt, Artificial Sequence
  Description of Artificial Sequence: Synthetic oligonucleotide
  modified_base (20)..(21): a, c, g, u, unknown or other
uaagggucauuagacaaaunn

SEQ ID NO: 2094 - RNA, 21 nt, Artificial Sequence
  Description of Artificial Sequence: Synthetic oligonucleotide
  modified_base (20)..(21): a, c, g, u, unknown or other
aagggucauuagacaaaugnn

SEQ ID NO: 2095 - RNA, 21 nt, Artificial Sequence
  Description of Artificial Sequence: Synthetic oligonucleotide
  modified_base (20)..(21): a, c, g, u, unknown or other
agggucauuagacaaaugunn

SEQ ID NO: 2096 - RNA, 21 nt, Artificial Sequence
  Description of Artificial Sequence: Synthetic oligonucleotide
  modified_base (20)..(21): a, c, g, u, unknown or other
gggucauuagacaaaugucnn

SEQ ID NO: 2097 - RNA, 21 nt, Artificial Sequence
  Description of Artificial Sequence: Synthetic oligonucleotide
  modified_base (20)..(21): a, c, g, u, unknown or other
ggucauuagacaaaugucunn

SEQ ID NO: 2098 - RNA, 21 nt, Artificial Sequence
  Description of Artificial Sequence: Synthetic oligonucleotide
  modified_base (20)..(21): a, c, g, u, unknown or other
gucauuagacaaaugucuunn

SEQ ID NO: 2099 - RNA, 21 nt, Artificial Sequence
  Description of Artificial Sequence: Synthetic oligonucleotide
  modified_base (20)..(21): a, c, g, u, unknown or other
ucauuagacaaaugucuugnn

SEQ ID NO: 2100 - RNA, 21 nt, Artificial Sequence
  Description of Artificial Sequence: Synthetic oligonucleotide
  modified_base (20)..(21): a, c, g, u, unknown or other
gcccugccgcucauggugcnn

SEQ ID NO: 2101 - RNA, 21 nt, Artificial Sequence
  Description of Artificial Sequence: Synthetic oligonucleotide
  modified_base (20)..(21): a, c, g, u, unknown or other
cauuagacaaaugucuugann

SEQ ID NO: 2102 - RNA, 21 nt, Artificial Sequence
  Description of Artificial Sequence: Synthetic oligonucleotide
  modified_base (20)..(21): a, c, g, u, unknown or other
auuagacaaaugucuugaann

SEQ ID NO: 2103 - RNA, 21 nt, Artificial Sequence
  Description of Artificial Sequence: Synthetic oligonucleotide
  modified_base (20)..(21): a, c, g, u, unknown or other
uuagacaaaugucuugaagnn

SEQ ID NO: 2104 - RNA, 21 nt, Artificial Sequence
  Description of Artificial Sequence: Synthetic oligonucleotide
  modified_base (20)..(21): a, c, g, u, unknown or other
uagacaaaugucuugaagunn

SEQ ID NO: 2105 - RNA, 21 nt, Artificial Sequence
  Description of Artificial Sequence: Synthetic oligonucleotide
  modified_base (20)..(21): a, c, g, u, unknown or other
agacaaaugucuugaaguann

SEQ ID NO: 2106 - RNA, 21 nt, Artificial Sequence
  Description of Artificial Sequence: Synthetic oligonucleotide
  modified_base (20)..(21): a, c, g, u, unknown or other
gacaaaugucuugaaguagnn

SEQ ID NO: 2107 - RNA, 21 nt, Artificial Sequence
  Description of Artificial Sequence: Synthetic oligonucleotide
  modified_base (20)..(21): a, c, g, u, unknown or other
acaaaugucuugaaguagann

SEQ ID NO: 2108 - RNA, 21 nt, Artificial Sequence
  Description of Artificial Sequence: Synthetic oligonucleotide
  modified_base (20)..(21): a, c, g, u, unknown or other
cccugccgcucauggugccnn

SEQ ID NO: 2109 - RNA, 21 nt, Artificial Sequence
  Description of Artificial Sequence: Synthetic oligonucleotide
  modified_base (20)..(21): a, c, g, u, unknown or other
ccugccgcucauggugccann

SEQ ID NO: 2110 - RNA, 21 nt, Artificial Sequence
  Description of Artificial Sequence: Synthetic oligonucleotide
  modified_base (20)..(21): a, c, g, u, unknown or other
gaauuuaugaaugguucuunn

SEQ ID NO: 2111 - RNA, 21 nt, Artificial Sequence
  Description of Artificial Sequence: Synthetic oligonucleotide
  modified_base (20)..(21): a, c, g, u, unknown or other
cugccgcucauggugccagnn

SEQ ID NO: 2112 - RNA, 21 nt, Artificial Sequence
  Description of Artificial Sequence: Synthetic oligonucleotide
  modified_base (20)..(21): a, c, g, u, unknown or other
aauuuaugaaugguucuuunn

SEQ ID NO: 2113 - RNA, 21 nt, Artificial Sequence
  Description of Artificial Sequence: Synthetic oligonucleotide
  modified_base (20)..(21): a, c, g, u, unknown or other
auuuaugaaugguucuuuann

SEQ ID NO: 2114 - RNA, 21 nt, Artificial Sequence
  Description of Artificial Sequence: Synthetic oligonucleotide
  modified_base (20)..(21): a, c, g, u, unknown or other
uuuaugaaugguucuuuaunn

SEQ ID NO: 2115 - RNA, 21 nt, Artificial Sequence
  Description of Artificial Sequence: Synthetic oligonucleotide
  modified_base (20)..(21): a, c, g, u, unknown or other
uuaugaaugguucuuuaucnn

SEQ ID NO: 2116 - RNA, 21 nt, Artificial Sequence
  Description of Artificial Sequence: Synthetic oligonucleotide
  modified_base (20)..(21): a, c, g, u, unknown or other
uaugaaugguucuuuaucann

SEQ ID NO: 2117 - RNA, 21 nt, Artificial Sequence
  Description of Artificial Sequence: Synthetic oligonucleotide
  modified_base (20)..(21): a, c, g, u, unknown or other
augaaugguucuuuaucaunn

SEQ ID NO: 2118 - RNA, 21 nt, Artificial Sequence
  Description of Artificial Sequence: Synthetic oligonucleotide
  modified_base (20)..(21): a, c, g, u, unknown or other
ugaaugguucuuuaucauunn

SEQ ID NO: 2119 - RNA, 21 nt, Artificial Sequence
  Description of Artificial Sequence: Synthetic oligonucleotide
  modified_base (20)..(21): a, c, g, u, unknown or other
gaaugguucuuuaucauuunn

SEQ ID NO: 2120 - RNA, 21 nt, Artificial Sequence
  Description of Artificial Sequence: Synthetic oligonucleotide
  modified_base (20)..(21): a, c, g, u, unknown or other
aaugguucuuuaucauuucnn

SEQ ID NO: 2121 - RNA, 21 nt, Artificial Sequence
  Description of Artificial Sequence: Synthetic oligonucleotide
  modified_base (20)..(21): a, c, g, u, unknown or other
augguucuuuaucauuucunn

SEQ ID NO: 2122 - RNA, 21 nt, Artificial Sequence
  Description of Artificial Sequence: Synthetic oligonucleotide
  modified_base (20)..(21): a, c, g, u, unknown or other
ugccgcucauggugccagcnn

SEQ ID NO: 2123 - RNA, 21 nt, Artificial Sequence
  Description of Artificial Sequence: Synthetic oligonucleotide
  modified_base (20)..(21): a, c, g, u, unknown or other
ugguucuuuaucauuucucnn

SEQ ID NO: 2124 - RNA, 21 nt, Artificial Sequence
  Description of Artificial Sequence: Synthetic oligonucleotide
  modified_base (20)..(21): a, c, g, u, unknown or other
gguucuuuaucauuucucunn

SEQ ID NO: 2125 - RNA, 21 nt, Artificial Sequence
  Description of Artificial Sequence: Synthetic oligonucleotide
  modified_base (20)..(21): a, c, g, u, unknown or other
guucuuuaucauuucucuunn

SEQ ID NO: 2126 - RNA, 21 nt, Artificial Sequence
  Description of Artificial Sequence: Synthetic oligonucleotide
  modified_base (20)..(21): a, c, g, u, unknown or other
uucuuuaucauuucucuucnn

SEQ ID NO: 2127 - RNA, 21 nt, Artificial Sequence
  Description of Artificial Sequence: Synthetic oligonucleotide
  modified_base (20)..(21): a, c, g, u, unknown or other
ucuuuaucauuucucuuccnn

SEQ ID NO: 2128 - RNA, 21 nt, Artificial Sequence
  Description of Artificial Sequence: Synthetic oligonucleotide
  modified_base (20)..(21): a, c, g, u, unknown or other
cuuuaucauuucucuucccnn

SEQ ID NO: 2129 - RNA, 21 nt, Artificial Sequence
  Description of Artificial Sequence: Synthetic oligonucleotide
  modified_base (20)..(21): a, c, g, u, unknown or other
uuuaucauuucucuuccccnn

SEQ ID NO: 2130 - RNA, 21 nt, Artificial Sequence
  Description of Artificial Sequence: Synthetic oligonucleotide
  modified_base (20)..(21): a, c, g, u, unknown or other
uuaucauuucucuucccccnn

SEQ ID NO: 2131 - RNA, 21 nt, Artificial Sequence
  Description of Artificial Sequence: Synthetic oligonucleotide
  modified_base (20)..(21): a, c, g, u, unknown or other
uaucauuucucuucccccunn

SEQ ID NO: 2132 - RNA, 21 nt, Artificial Sequence
  Description of Artificial Sequence: Synthetic oligonucleotide
  modified_base (20)..(21): a, c, g, u, unknown or other
aucauuucucuucccccuunn

SEQ ID NO: 2133 - RNA, 21 nt, Artificial Sequence
  Description of Artificial Sequence: Synthetic oligonucleotide
  modified_base (20)..(21): a, c, g, u, unknown or other
gccgcucauggugccagccnn

SEQ ID NO: 2134 - RNA, 21 nt, Artificial Sequence
  Description of Artificial Sequence: Synthetic oligonucleotide
  modified_base (20)..(21): a, c, g, u, unknown or other
ucauuucucuucccccuuunn

SEQ ID NO: 2135 - RNA, 21 nt, Artificial Sequence
  Description of Artificial Sequence: Synthetic oligonucleotide
  modified_base (20)..(21): a, c, g, u, unknown or other
cauuucucuucccccuuuunn

SEQ ID NO: 2136 - RNA, 21 nt, Artificial Sequence
  Description of Artificial Sequence: Synthetic oligonucleotide
  modified_base (20)..(21): a, c, g, u, unknown or other
auuucucuucccccuuuuunn

SEQ ID NO: 2137 - RNA, 21 nt, Artificial Sequence
  Description of Artificial Sequence: Synthetic oligonucleotide
  modified_base (20)..(21): a, c, g, u, unknown or other
uuucucuucccccuuuuugnn

SEQ ID NO: 2138 - RNA, 21 nt, Artificial Sequence
  Description of Artificial Sequence: Synthetic oligonucleotide
  modified_base (20)..(21): a, c, g, u, unknown or other
uucucuucccccuuuuuggnn

SEQ ID NO: 2139 - RNA, 21 nt, Artificial Sequence
  Description of Artificial Sequence: Synthetic oligonucleotide
  modified_base (20)..(21): a, c, g, u, unknown or other
ucucuucccccuuuuuggcnn

SEQ ID NO: 2140 - RNA, 21 nt, Artificial Sequence
  Description of Artificial Sequence: Synthetic oligonucleotide
  modified_base (20)..(21): a, c, g, u, unknown or other
cucuucccccuuuuuggcann

SEQ ID NO: 2141 - RNA, 21 nt, Artificial Sequence
  Description of Artificial Sequence: Synthetic oligonucleotide
  modified_base (20)..(21): a, c, g, u, unknown or other
ucuucccccuuuuuggcaunn

SEQ ID NO: 2142 - RNA, 21 nt, Artificial Sequence
  Description of Artificial Sequence: Synthetic oligonucleotide
  modified_base (20)..(21): a, c, g, u, unknown or other
cuucccccuuuuuggcaucnn

SEQ ID NO: 2143 - RNA, 21 nt, Artificial Sequence
  Description of Artificial Sequence: Synthetic oligonucleotide
  modified_base (20)..(21): a, c, g, u, unknown or other
uucccccuuuuuggcauccnn

SEQ ID NO: 2144 - RNA, 21 nt, Artificial Sequence
  Description of Artificial Sequence: Synthetic oligonucleotide
  modified_base (20)..(21): a, c, g, u, unknown or other
ccgcucauggugccagcccnn

SEQ ID NO: 2145 - RNA, 21 nt, Artificial Sequence
  Description of Artificial Sequence: Synthetic oligonucleotide
  modified_base (20)..(21): a, c, g, u, unknown or other
ucccccuuuuuggcauccunn

SEQ ID NO: 2146 - RNA, 21 nt, Artificial Sequence
  Description of Artificial Sequence: Synthetic oligonucleotide
  modified_base (20)..(21): a, c, g, u, unknown or other
cccccuuuuuggcauccugnn

SEQ ID NO: 2147 - RNA, 21 nt, Artificial Sequence
  Description of Artificial Sequence: Synthetic oligonucleotide
  modified_base (20)..(21): a, c, g, u, unknown or other
ccccuuuuuggcauccuggnn

SEQ ID NO: 2148 - RNA, 21 nt, Artificial Sequence
  Description of Artificial Sequence: Synthetic oligonucleotide
  modified_base (20)..(21): a, c, g, u, unknown or other
cccuuuuuggcauccuggcnn

SEQ ID NO: 2149 - RNA, 21 nt, Artificial Sequence
  Description of Artificial Sequence: Synthetic oligonucleotide
  modified_base (20)..(21): a, c, g, u, unknown or other
ccuuuuuggcauccuggcunn

SEQ ID NO: 2150 - RNA, 21 nt, Artificial Sequence
  Description of Artificial Sequence: Synthetic oligonucleotide
  modified_base (20)..(21): a, c, g, u, unknown or other
cuuuuuggcauccuggcuunn

SEQ ID NO: 2151 - RNA, 21 nt, Artificial Sequence
  Description of Artificial Sequence: Synthetic oligonucleotide
  modified_base (20)..(21): a, c, g, u, unknown or other
uuuuuggcauccuggcuugnn

SEQ ID NO: 2152 - RNA, 21 nt, Artificial Sequence
  Description of Artificial Sequence: Synthetic oligonucleotide
  modified_base (20)..(21): a, c, g, u, unknown or other
uuuuggcauccuggcuugcnn

SEQ ID NO: 2153 - RNA, 21 nt, Artificial Sequence
  Description of Artificial Sequence: Synthetic oligonucleotide
  modified_base (20)..(21): a, c, g, u, unknown or other
uuuggcauccuggcuugccnn

SEQ ID NO: 2154 - RNA, 21 nt, Artificial Sequence
  Description of Artificial Sequence: Synthetic oligonucleotide
  modified_base (20)..(21): a, c, g, u, unknown or other
uuggcauccuggcuugccunn

SEQ ID NO: 2155 - RNA, 21 nt, Artificial Sequence
  Description of Artificial Sequence: Synthetic oligonucleotide
  modified_base (20)..(21): a, c, g, u, unknown or other
cgcucauggugccagcccann

SEQ ID NO: 2156 - RNA, 21 nt, Artificial Sequence
  Description of Artificial Sequence: Synthetic oligonucleotide
  modified_base (20)..(21): a, c, g, u, unknown or other
uggcauccuggcuugccucnn

SEQ ID NO: 2157 - RNA, 21 nt, Artificial Sequence
  Description of Artificial Sequence: Synthetic oligonucleotide
  modified_base (20)..(21): a, c, g, u, unknown or other
ggcauccuggcuugccuccnn

SEQ ID NO: 2158 - RNA, 21 nt, Artificial Sequence
  Description of Artificial Sequence: Synthetic oligonucleotide
  modified_base (20)..(21): a, c, g, u, unknown or other
gcauccuggcuugccuccann

SEQ ID NO: 2159 - RNA, 21 nt, Artificial Sequence
  Description of Artificial Sequence: Synthetic oligonucleotide
  modified_base (20)..(21): a, c, g, u, unknown or other
cauccuggcuugccuccagnn

SEQ ID NO: 2160 - RNA, 21 nt, Artificial Sequence
  Description of Artificial Sequence: Synthetic oligonucleotide
  modified_base (20)..(21): a, c, g, u, unknown or other
auccuggcuugccuccagunn

SEQ ID NO: 2161 - RNA, 21 nt, Artificial Sequence
  Description of Artificial Sequence: Synthetic oligonucleotide
  modified_base (20)..(21): a, c, g, u, unknown or other
uccuggcuugccuccaguunn

SEQ ID NO: 2162 - RNA, 21 nt, Artificial Sequence
  Description of Artificial Sequence: Synthetic oligonucleotide
  modified_base (20)..(21): a, c, g, u, unknown or other
ccuggcuugccuccaguuunn

SEQ ID NO: 2163 - RNA, 21 nt, Artificial Sequence
  Description of Artificial Sequence: Synthetic oligonucleotide
  modified_base (20)..(21): a, c, g, u, unknown or other
cuggcuugccuccaguuuunn

SEQ ID NO: 2164 - RNA, 21 nt, Artificial Sequence
  Description of Artificial Sequence: Synthetic oligonucleotide
  modified_base (20)..(21): a, c, g, u, unknown or other
uggcuugccuccaguuuuann

SEQ ID NO: 2165 - RNA, 21 nt, Artificial Sequence
  Description of Artificial Sequence: Synthetic oligonucleotide
  modified_base (20)..(21): a, c, g, u, unknown or other
ggcuugccuccaguuuuagnn

SEQ ID NO: 2166 - RNA, 21 nt, Artificial Sequence
  Description of Artificial Sequence: Synthetic oligonucleotide
  modified_base (20)..(21): a, c, g, u, unknown or other
gcucauggugccagcccagnn

SEQ ID NO: 2167 - RNA, 21 nt, Artificial Sequence
  Description of Artificial Sequence: Synthetic oligonucleotide
  modified_base (20)..(21): a, c, g, u, unknown or other
gcuugccuccaguuuuaggnn

SEQ ID NO: 2168 - RNA, 21 nt, Artificial Sequence
  Description of Artificial Sequence: Synthetic oligonucleotide
  modified_base (20)..(21): a, c, g, u, unknown or other
cuugccuccaguuuuaggunn

SEQ ID NO: 2169 - RNA, 21 nt, Artificial Sequence
  Description of Artificial Sequence: Synthetic oligonucleotide
  modified_base (20)..(21): a, c, g, u, unknown or other
uugccuccaguuuuaggucnn

SEQ ID NO: 2170 - RNA, 21 nt, Artificial Sequence
  Description of Artificial Sequence: Synthetic oligonucleotide
  modified_base (20)..(21): a, c, g, u, unknown or other
ugccuccaguuuuagguccnn

SEQ ID NO: 2171 - RNA, 21 nt, Artificial Sequence
  Description of Artificial Sequence: Synthetic oligonucleotide
  modified_base (20)..(21): a, c, g, u, unknown or other
cucauggugccagcccagann

SEQ ID NO: 2172 - RNA, 21 nt, Artificial Sequence
  Description of Artificial Sequence: Synthetic oligonucleotide
  modified_base (20)..(21): a, c, g, u, unknown or other
ucauggugccagcccagagnn

SEQ ID NO: 2173 - RNA, 21 nt, Artificial Sequence
  Description of Artificial Sequence: Synthetic oligonucleotide
  modified_base (20)..(21): a, c, g, u, unknown or other
uuaguuugcuucuguaagcnn

SEQ ID NO: 2174 - RNA, 21 nt, Artificial Sequence
  Description of Artificial Sequence: Synthetic oligonucleotide
  modified_base (20)..(21): a, c, g, u, unknown or other
uaguuugcuucuguaagcann

SEQ ID NO: 2175 - RNA, 21 nt, Artificial Sequence
  Description of Artificial Sequence: Synthetic oligonucleotide
  modified_base (20)..(21): a, c, g, u, unknown or other
aguuugcuucuguaagcaann

SEQ ID NO: 2176 - RNA, 21 nt, Artificial Sequence
  Description of Artificial Sequence: Synthetic oligonucleotide
  modified_base (20)..(21): a, c, g, u, unknown or other
cauggugccagcccagagann

SEQ ID NO: 2177 - RNA, 21 nt, Artificial Sequence
  Description of Artificial Sequence: Synthetic oligonucleotide
  modified_base (20)..(21): a, c, g, u, unknown or other
auggugccagcccagagagnn

SEQ ID NO: 2178 - RNA, 21 nt, Artificial Sequence
  Description of Artificial Sequence: Synthetic oligonucleotide
  modified_base (20)..(21): a, c, g, u, unknown or other
gaacaccugcugagggggcnn

SEQ ID NO: 2179 - RNA, 21 nt, Artificial Sequence
  Description of Artificial Sequence: Synthetic oligonucleotide
  modified_base (20)..(21): a, c, g, u, unknown or other
aacaccugcugagggggcunn

SEQ ID NO: 2180 - RNA, 21 nt, Artificial Sequence
  Description of Artificial Sequence: Synthetic oligonucleotide
  modified_base (20)..(21): a, c, g, u, unknown or other
acaccugcugagggggcucnn

SEQ ID NO: 2181 - RNA, 21 nt, Artificial Sequence
  Description of Artificial Sequence: Synthetic oligonucleotide
  modified_base (20)..(21): a, c, g, u, unknown or other
uggugccagcccagagaggnn

SEQ ID NO: 2182 - RNA, 21 nt, Artificial Sequence
  Description of Artificial Sequence: Synthetic oligonucleotide
  modified_base (20)..(21): a, c, g, u, unknown or other
caccugcugagggggcucunn

SEQ ID NO: 2183 - RNA, 21 nt, Artificial Sequence
  Description of Artificial Sequence: Synthetic oligonucleotide
  modified_base (20)..(21): a, c, g, u, unknown or other
accugcugagggggcucuunn

SEQ ID NO: 2184 - RNA, 21 nt, Artificial Sequence
  Description of Artificial Sequence: Synthetic oligonucleotide
  modified_base (20)..(21): a, c, g, u, unknown or other
ccugcugagggggcucuuunn

SEQ ID NO: 2185 - RNA, 21 nt, Artificial Sequence
  Description of Artificial Sequence: Synthetic oligonucleotide
  modified_base (20)..(21): a, c, g, u, unknown or other
cugcugagggggcucuuucnn

SEQ ID NO: 2186 - RNA, 21 nt, Artificial Sequence
  Description of Artificial Sequence: Synthetic oligonucleotide
  modified_base (20)..(21): a, c, g, u, unknown or other
ugcugagggggcucuuuccnn

SEQ ID NO: 2187 - RNA, 21 nt, Artificial Sequence
  Description of Artificial Sequence: Synthetic oligonucleotide
  modified_base (20)..(21): a, c, g, u, unknown or other
gcugagggggcucuuucccnn

SEQ ID NO: 2188 - RNA, 21 nt, Artificial Sequence
  Description of Artificial Sequence: Synthetic oligonucleotide
  modified_base (20)..(21): a, c, g, u, unknown or other
cugagggggcucuuucccunn

SEQ ID NO: 2189 - RNA, 21 nt, Artificial Sequence
  Description of Artificial Sequence: Synthetic oligonucleotide
  modified_base (20)..(21): a, c, g, u, unknown or other
ugagggggcucuuucccucnn

SEQ ID NO: 2190 - RNA, 21 nt, Artificial Sequence
  Description of Artificial Sequence: Synthetic oligonucleotide
  modified_base (20)..(21): a, c, g, u, unknown or other
gagggggcucuuucccucann

SEQ ID NO: 2191 - RNA, 21 nt, Artificial Sequence
  Description of Artificial Sequence: Synthetic oligonucleotide
  modified_base (20)..(21): a, c, g, u, unknown or other
ggugccagcccagagagggnn

SEQ ID NO: 2192 - RNA, 21 nt, Artificial Sequence
  Description of Artificial Sequence: Synthetic oligonucleotide
  modified_base (20)..(21): a, c, g, u, unknown or other
gugccagcccagagaggggnn

SEQ ID NO: 2193 - RNA, 21 nt, Artificial Sequence
  Description of Artificial Sequence: Synthetic oligonucleotide
  modified_base (20)..(21): a, c, g, u, unknown or other
guauacuucaaguaagaucnn

SEQ ID NO: 2194 - RNA, 21 nt, Artificial Sequence
  Description of Artificial Sequence: Synthetic oligonucleotide
  modified_base (20)..(21): a, c, g, u, unknown or other
uauacuucaaguaagaucann

SEQ ID NO: 2195 - RNA, 21 nt, Artificial Sequence
  Description of Artificial Sequence: Synthetic oligonucleotide
  modified_base (20)..(21): a, c, g, u, unknown or other
ugccagcccagagaggggcnn

SEQ ID NO: 2196 - RNA, 21 nt, Artificial Sequence
  Description of Artificial Sequence: Synthetic oligonucleotide
  modified_base (20)..(21): a, c, g, u, unknown or other
auacuucaaguaagaucaann

SEQ ID NO: 2197 - RNA, 21 nt, Artificial Sequence
  Description of Artificial Sequence: Synthetic oligonucleotide
  modified_base (20)..(21): a, c, g, u, unknown or other
uacuucaaguaagaucaagnn

SEQ ID NO: 2198 - RNA, 21 nt, Artificial Sequence
  Description of Artificial Sequence: Synthetic oligonucleotide
  modified_base (20)..(21): a, c, g, u, unknown or other
acuucaaguaagaucaagann

SEQ ID NO: 2199 - RNA, 21 nt, Artificial Sequence
  Description of Artificial Sequence: Synthetic oligonucleotide
  modified_base (20)..(21): a, c, g, u, unknown or other
cuucaaguaagaucaagaann

SEQ ID NO: 2200 - RNA, 21 nt, Artificial Sequence
  Description of Artificial Sequence: Synthetic oligonucleotide
  modified_base (20)..(21): a, c, g, u, unknown or other
uucaaguaagaucaagaaunn

SEQ ID NO: 2201 - RNA, 21 nt, Artificial Sequence
  Description of Artificial Sequence: Synthetic oligonucleotide
  modified_base (20)..(21): a, c, g, u, unknown or other
ucaaguaagaucaagaaucnn

SEQ ID NO: 2202 - RNA, 21 nt, Artificial Sequence
  Description of Artificial Sequence: Synthetic oligonucleotide
  modified_base (20)..(21): a, c, g, u, unknown or other
caaguaagaucaagaaucunn

SEQ ID NO: 2203 - RNA, 21 nt, Artificial Sequence
  Description of Artificial Sequence: Synthetic oligonucleotide
  modified_base (20)..(21): a, c, g, u, unknown or other
aaguaagaucaagaaucuunn

SEQ ID NO: 2204 - RNA, 21 nt, Artificial Sequence
  Description of Artificial Sequence: Synthetic oligonucleotide
  modified_base (20)..(21): a, c, g, u, unknown or other
aguaagaucaagaaucuuunn

SEQ ID NO: 2205 - RNA, 21 nt, Artificial Sequence
  Description of Artificial Sequence: Synthetic oligonucleotide
  modified_base (20)..(21): a, c, g, u, unknown or other
guaagaucaagaaucuuuunn

SEQ ID NO: 2206 - RNA, 21 nt, Artificial Sequence
  Description of Artificial Sequence: Synthetic oligonucleotide
  modified_base (20)..(21): a, c, g, u, unknown or other
uaagaucaagaaucuuuugnn

SEQ ID NO: 2207 - RNA, 21 nt, Artificial Sequence
  Description of Artificial Sequence: Synthetic oligonucleotide
  modified_base (20)..(21): a, c, g, u, unknown or other
aagaucaagaaucuuuugunn

SEQ ID NO: 2208 - RNA, 21 nt, Artificial Sequence
  Description of Artificial Sequence: Synthetic oligonucleotide
  modified_base (20)..(21): a, c, g, u, unknown or other
agaucaagaaucuuuugugnn

SEQ ID NO: 2209 - RNA, 21 nt, Artificial Sequence
  Description of Artificial Sequence: Synthetic oligonucleotide
  modified_base (20)..(21): a, c, g, u, unknown or other
gaucaagaaucuuuugugann

SEQ ID NO: 2210 - RNA, 21 nt, Artificial Sequence
  Description of Artificial Sequence: Synthetic oligonucleotide
  modified_base (20)..(21): a, c, g, u, unknown or other
aucaagaaucuuuugugaann

SEQ ID NO: 2211 - RNA, 21 nt, Artificial Sequence
  Description of Artificial Sequence: Synthetic oligonucleotide
  modified_base (20)..(21): a, c, g, u, unknown or other
ucaagaaucuuuugugaaann

SEQ ID NO: 2212 - RNA, 21 nt, Artificial Sequence
  Description of Artificial Sequence: Synthetic oligonucleotide
  modified_base (20)..(21): a, c, g, u, unknown or other
uauagaaauuuacuauguann

SEQ ID NO: 2213 - RNA, 21 nt, Artificial Sequence
  Description of Artificial Sequence: Synthetic oligonucleotide
  modified_base (20)..(21): a, c, g, u, unknown or other
auagaaauuuacuauguaann

SEQ ID NO: 2214 - RNA, 21 nt, Artificial Sequence
  Description of Artificial Sequence: Synthetic oligonucleotide
  modified_base (20)..(21): a, c, g, u, unknown or other
uagaaauuuacuauguaaann

SEQ ID NO: 2215 - RNA, 21 nt, Artificial Sequence
  Description of Artificial Sequence: Synthetic oligonucleotide
  modified_base (20)..(21): a, c, g, u, unknown or other
agaaauuuacuauguaaaunn

SEQ ID NO: 2216 - RNA, 21 nt, Artificial Sequence
  Description of Artificial Sequence: Synthetic oligonucleotide
  modified_base (20)..(21): a, c, g, u, unknown or other
gaaauuuacuauguaaaugnn

SEQ ID NO: 2217 - RNA, 21 nt, Artificial Sequence
  Description of Artificial Sequence: Synthetic oligonucleotide
  modified_base (20)..(21): a, c, g, u, unknown or other
aaauuuacuauguaaaugcnn

SEQ ID NO: 2218 - RNA, 21 nt, Artificial Sequence
  Description of Artificial Sequence: Synthetic oligonucleotide
  modified_base (20)..(21): a, c, g, u, unknown or other
aauuuacuauguaaaugcunn

SEQ ID NO: 2219 - RNA, 21 nt, Artificial Sequence
  Description of Artificial Sequence: Synthetic oligonucleotide
  modified_base (20)..(21): a, c, g, u, unknown or other
auuuacuauguaaaugcuunn

SEQ ID NO: 2220 - RNA, 21 nt, Artificial Sequence
  Description of Artificial Sequence: Synthetic oligonucleotide
  modified_base (20)..(21): a, c, g, u, unknown or other
uuuacuauguaaaugcuugnn

SEQ ID NO: 2221 - RNA, 21 nt, Artificial Sequence
  Description of Artificial Sequence: Synthetic oligonucleotide
  modified_base (20)..(21): a, c, g, u, unknown or other
uuacuauguaaaugcuugann

SEQ ID NO: 2222 - RNA, 21 nt, Artificial Sequence
  Description of Artificial Sequence: Synthetic oligonucleotide
  modified_base (20)..(21): a, c, g, u, unknown or other
uacuauguaaaugcuugaunn

SEQ ID NO: 2223 - RNA, 21 nt, Artificial Sequence
  Description of Artificial Sequence: Synthetic oligonucleotide
  modified_base (20)..(21): a, c, g, u, unknown or other
acuauguaaaugcuugaugnn

SEQ ID NO: 2224 - RNA, 21 nt, Artificial Sequence
  Description of Artificial Sequence: Synthetic oligonucleotide
  modified_base (20)..(21): a, c, g, u, unknown or other
cuauguaaaugcuugauggnn

SEQ ID NO: 2225 - RNA, 21 nt, Artificial Sequence
  Description of Artificial Sequence: Synthetic oligonucleotide
  modified_base (20)..(21): a, c, g, u, unknown or other
uauguaaaugcuugauggann

SEQ ID NO: 2226 - RNA, 21 nt, Artificial Sequence
  Description of Artificial Sequence: Synthetic oligonucleotide
  modified_base (20)..(21): a, c, g, u, unknown or other
auguaaaugcuugauggaann

SEQ ID NO: 2227 - RNA, 21 nt, Artificial Sequence
  Description of Artificial Sequence: Synthetic oligonucleotide
  modified_base (20)..(21): a, c, g, u, unknown or other
uguaaaugcuugauggaaunn

SEQ ID NO: 2228 - RNA, 21 nt, Artificial Sequence
  Description of Artificial Sequence: Synthetic oligonucleotide
  modified_base (20)..(21): a, c, g, u, unknown or other
guaaaugcuugauggaauunn

SEQ ID NO: 2229 - RNA, 21 nt, Artificial Sequence
  Description of Artificial Sequence: Synthetic oligonucleotide
  modified_base (20)..(21): a, c, g, u, unknown or other
uaaaugcuugauggaauuunn

SEQ ID NO: 2230 - RNA, 21 nt, Artificial Sequence
  Description of Artificial Sequence: Synthetic oligonucleotide
  modified_base (20)..(21): a, c, g, u, unknown or other
aaaugcuugauggaauuuunn

SEQ ID NO: 2231 - RNA, 21 nt, Artificial Sequence
  Description of Artificial Sequence: Synthetic oligonucleotide
  modified_base (20)..(21): a, c, g, u, unknown or other
aaugcuugauggaauuuuunn

SEQ ID NO: 2232 - RNA, 21 nt, Artificial Sequence
  Description of Artificial Sequence: Synthetic oligonucleotide
  modified_base (20)..(21): a, c, g, u, unknown or other
augcuugauggaauuuuuunn

SEQ ID NO: 2233 - RNA, 21 nt, Artificial Sequence
  Description of Artificial Sequence: Synthetic oligonucleotide
  modified_base (20)..(21): a, c, g, u, unknown or other
ugcuugauggaauuuuuucnn

SEQ ID NO: 2234 - RNA, 21 nt, Artificial Sequence
  Description of Artificial Sequence: Synthetic oligonucleotide
  modified_base (20)..(21): a, c, g, u, unknown or other
gcuugauggaauuuuuuccnn

SEQ ID NO: 2235 - RNA, 21 nt, Artificial Sequence
  Description of Artificial Sequence: Synthetic oligonucleotide
  modified_base (20)..(21): a, c, g, u, unknown or other
cuugauggaauuuuuuccunn

SEQ ID NO: 2236 - RNA, 21 nt, Artificial Sequence
  Description of Artificial Sequence: Synthetic oligonucleotide
  modified_base (20)..(21): a, c, g, u, unknown or other
uugauggaauuuuuuccugnn

SEQ ID NO: 2237 - RNA, 21 nt, Artificial Sequence
  Description of Artificial Sequence: Synthetic oligonucleotide
  modified_base (20)..(21): a, c, g, u, unknown or other
ugauggaauuuuuuccugcnn

SEQ ID NO: 2238 - RNA, 21 nt, Artificial Sequence
  Description of Artificial Sequence: Synthetic oligonucleotide
  modified_base (20)..(21): a, c, g, u, unknown or other
gauggaauuuuuuccugcunn

SEQ ID NO: 2239 - RNA, 21 nt, Artificial Sequence
  Description of Artificial Sequence: Synthetic oligonucleotide
  modified_base (20)..(21): a, c, g, u, unknown or other
auggaauuuuuuccugcuann

SEQ ID NO: 2240 - RNA, 21 nt, Artificial Sequence
  Description of Artificial Sequence: Synthetic oligonucleotide
  modified_base (20)..(21): a, c, g, u, unknown or other
uggaauuuuuuccugcuagnn

SEQ ID NO: 2241 - RNA, 21 nt, Artificial Sequence
  Description of Artificial Sequence: Synthetic oligonucleotide
  modified_base (20)..(21): a, c, g, u, unknown or other
ggaauuuuuuccugcuagunn

SEQ ID NO: 2242 - RNA, 21 nt, Artificial Sequence
  Description of Artificial Sequence: Synthetic oligonucleotide
  modified_base (20)..(21): a, c, g, u, unknown or other
gaauuuuuuccugcuagugnn

SEQ ID NO: 2243 - RNA, 21 nt, Artificial Sequence
  Description of Artificial Sequence: Synthetic oligonucleotide
  modified_base (20)..(21): a, c, g, u, unknown or other
aauuuuuuccugcuagugunn

SEQ ID NO: 2244 - RNA, 21 nt, Artificial Sequence
  Description of Artificial Sequence: Synthetic oligonucleotide
  modified_base (20)..(21): a, c, g, u, unknown or other
auuuuuuccugcuaguguann

SEQ ID NO: 2245 - RNA, 21 nt, Artificial Sequence
  Description of Artificial Sequence: Synthetic oligonucleotide
  modified_base (20)..(21): a, c, g, u, unknown or other
uuuuuuccugcuaguguagnn

SEQ ID NO: 2246 - RNA, 21 nt, Artificial Sequence
  Description of Artificial Sequence: Synthetic oligonucleotide
  modified_base (20)..(21): a, c, g, u, unknown or other
uuuuuccugcuaguguagcnn

SEQ ID NO: 2247 - RNA, 21 nt, Artificial Sequence
  Description of Artificial Sequence: Synthetic oligonucleotide
  modified_base (20)..(21): a, c, g, u, unknown or other
uuuuccugcuaguguagcunn

SEQ ID NO: 2248 - RNA, 21 nt, Artificial Sequence
  Description of Artificial Sequence: Synthetic oligonucleotide
  modified_base (20)..(21): a, c, g, u, unknown or other
uuuccugcuaguguagcuunn

SEQ ID NO: 2249 - RNA, 21 nt, Artificial Sequence
  Description of Artificial Sequence: Synthetic oligonucleotide
  modified_base (20)..(21): a, c, g, u, unknown or other
uuccugcuaguguagcuucnn

SEQ ID NO: 2250 - RNA, 21 nt, Artificial Sequence
  Description of Artificial Sequence: Synthetic oligonucleotide
  modified_base (20)..(21): a, c, g, u, unknown or other
uccugcuaguguagcuucunn

SEQ ID NO: 2251 - RNA, 21 nt, Artificial Sequence
  Description of Artificial Sequence: Synthetic oligonucleotide
  modified_base (20)..(21): a, c, g, u, unknown or other
ccugcuaguguagcuucugnn

SEQ ID NO: 2252 - RNA, 21 nt, Artificial Sequence
  Description of Artificial Sequence: Synthetic oligonucleotide
  modified_base (20)..(21): a, c, g, u, unknown or other
cugcuaguguagcuucugann

SEQ ID NO: 2253 - RNA, 21 nt, Artificial Sequence
  Description of Artificial Sequence: Synthetic oligonucleotide
  modified_base (20)..(21): a, c, g, u, unknown or other
ugcuaguguagcuucugaann

SEQ ID NO: 2254 - RNA, 21 nt, Artificial Sequence
  Description of Artificial Sequence: Synthetic oligonucleotide
  modified_base (20)..(21): a, c, g, u, unknown or other
gcuaguguagcuucugaaann

SEQ ID NO: 2255 - RNA, 21 nt, Artificial Sequence
  Description of Artificial Sequence: Synthetic oligonucleotide
  modified_base (20)..(21): a, c, g, u, unknown or other
cuaguguagcuucugaaagnn

SEQ ID NO: 2256 - RNA, 21 nt, Artificial Sequence
  Description of Artificial Sequence: Synthetic oligonucleotide
  modified_base (20)..(21): a, c, g, u, unknown or other
uaguguagcuucugaaaggnn

SEQ ID NO: 2257 - RNA, 21 nt, Artificial Sequence
  Description of Artificial Sequence: Synthetic oligonucleotide
  modified_base (20)..(21): a, c, g, u, unknown or other
aguguagcuucugaaaggunn

SEQ ID NO: 2258 - RNA, 21 nt, Artificial Sequence
  Description of Artificial Sequence: Synthetic oligonucleotide
  modified_base (20)..(21): a, c, g, u, unknown or other
guguagcuucugaaaggugnn

SEQ ID NO: 2259 - RNA, 21 nt, Artificial Sequence
  Description of Artificial Sequence: Synthetic oligonucleotide
  modified_base (20)..(21): a, c, g, u, unknown or other
uguagcuucugaaaggugcnn

SEQ ID NO: 2260 - RNA, 21 nt, Artificial Sequence
  Description of Artificial Sequence: Synthetic oligonucleotide
  modified_base (20)..(21): a, c, g, u, unknown or other
guagcuucugaaaggugcunn

SEQ ID NO: 2261 - RNA, 21 nt, Artificial Sequence
  Description of Artificial Sequence: Synthetic oligonucleotide
  modified_base (20)..(21): a, c, g, u, unknown or other
uagcuucugaaaggugcuunn

SEQ ID NO: 2262 - RNA, 21 nt, Artificial Sequence
  Description of Artificial Sequence: Synthetic oligonucleotide
  modified_base (20)..(21): a, c, g, u, unknown or other
agcuucugaaaggugcuuunn

SEQ ID NO: 2263 - RNA, 21 nt, Artificial Sequence
  Description of Artificial Sequence: Synthetic oligonucleotide
  modified_base (20)..(21): a, c, g, u, unknown or other
gcuucugaaaggugcuuucnn

SEQ ID NO: 2264 - RNA, 21 nt, Artificial Sequence
  Description of Artificial Sequence: Synthetic oligonucleotide
  modified_base (20)..(21): a, c, g, u, unknown or other
uccauuuauuuaaaacuacnn

SEQ ID NO: 2265 - RNA, 21 nt, Artificial Sequence
  Description of Artificial Sequence: Synthetic oligonucleotide
  modified_base (20)..(21): a, c, g, u, unknown or other
ccauuuauuuaaaacuaccnn

SEQ ID NO: 2266 - RNA, 21 nt, Artificial Sequence
  Description of Artificial Sequence: Synthetic oligonucleotide
  modified_base (20)..(21): a, c, g, u, unknown or other
cauuuauuuaaaacuacccnn

SEQ ID NO: 2267 - RNA, 21 nt, Artificial Sequence
  Description of Artificial Sequence: Synthetic oligonucleotide
  modified_base (20)..(21): a, c, g, u, unknown or other
auuuauuuaaaacuacccann

SEQ ID NO: 2268 - RNA, 21 nt, Artificial Sequence
  Description of Artificial Sequence: Synthetic oligonucleotide
  modified_base (20)..(21): a, c, g, u, unknown or other
uuuauuuaaaacuacccaunn

SEQ ID NO: 2269 - RNA, 21 nt, Artificial Sequence
  Description of Artificial Sequence: Synthetic oligonucleotide
  modified_base (20)..(21): a, c, g, u, unknown or other
uuauuuaaaacuacccaugnn

SEQ ID NO: 2270 - RNA, 21 nt, Artificial Sequence
  Description of Artificial Sequence: Synthetic oligonucleotide
  modified_base (20)..(21): a, c, g, u, unknown or other
uauuuaaaacuacccaugcnn

SEQ ID NO: 2271 - RNA, 21 nt, Artificial Sequence
  Description of Artificial Sequence: Synthetic oligonucleotide
  modified_base (20)..(21): a, c, g, u, unknown or other
auuuaaaacuacccaugcann

SEQ ID NO: 2272 - RNA, 21 nt, Artificial Sequence
  Description of Artificial Sequence: Synthetic oligonucleotide
  modified_base (20)..(21): a, c, g, u, unknown or other
uuuaaaacuacccaugcaann

SEQ ID NO: 2273 - RNA, 21 nt, Artificial Sequence
  Description of Artificial Sequence: Synthetic oligonucleotide
  modified_base (20)..(21): a, c, g, u, unknown or other
uuaaaacuacccaugcaaunn

SEQ ID NO: 2274 - RNA, 21 nt, Artificial Sequence
  Description of Artificial Sequence: Synthetic oligonucleotide
  modified_base (20)..(21): a, c, g, u, unknown or other
uaaaacuacccaugcaauunn

SEQ ID NO: 2275 - RNA, 21 nt, Artificial Sequence
  Description of Artificial Sequence: Synthetic oligonucleotide
  modified_base (20)..(21): a, c, g, u, unknown or other
aaaacuacccaugcaauuann

SEQ ID NO: 2276 - RNA, 21 nt, Artificial Sequence
  Description of Artificial Sequence: Synthetic oligonucleotide
  modified_base (20)..(21): a, c, g, u, unknown or other
aaacuacccaugcaauuaann

SEQ ID NO: 2277 - RNA, 21 nt, Artificial Sequence
  Description of Artificial Sequence: Synthetic oligonucleotide
  modified_base (20)..(21): a, c, g, u, unknown or other
aacuacccaugcaauuaaann

SEQ ID NO: 2278 - RNA, 21 nt, Artificial Sequence
  Description of Artificial Sequence: Synthetic oligonucleotide
  modified_base (20)..(21): a, c, g, u, unknown or other
acuacccaugcaauuaaaann

SEQ ID NO: 2279 - RNA, 21 nt, Artificial Sequence
  Description of Artificial Sequence: Synthetic oligonucleotide
  modified_base (20)..(21): a, c, g, u, unknown or other
cuacccaugcaauuaaaagnn

SEQ ID NO: 2280 - RNA, 21 nt, Artificial Sequence
  Description of Artificial Sequence: Synthetic oligonucleotide
  modified_base (20)..(21): a, c, g, u, unknown or other
uacccaugcaauuaaaaggnn

SEQ ID NO: 2281 - RNA, 21 nt, Artificial Sequence
  Description of Artificial Sequence: Synthetic oligonucleotide
  modified_base (20)..(21): a, c, g, u, unknown or other
acccaugcaauuaaaaggunn

SEQ ID NO: 2282 - RNA, 21 nt, Artificial Sequence
  Description of Artificial Sequence: Synthetic oligonucleotide
  modified_base (20)..(21): a, c, g, u, unknown or other
cccaugcaauuaaaagguann

SEQ ID NO: 2283 - RNA, 21 nt, Artificial Sequence
  Description of Artificial Sequence: Synthetic oligonucleotide
  modified_base (20)..(21): a, c, g, u, unknown or other
ccaugcaauuaaaagguacnn

SEQ ID NO: 2284 - RNA, 21 nt, Artificial Sequence
  Description of Artificial Sequence: Synthetic oligonucleotide
  modified_base (20)..(21): a, c, g, u, unknown or other
caugcaauuaaaagguacann

SEQ ID NO: 2285 - RNA, 21 nt, Artificial Sequence
  Description of Artificial Sequence: Synthetic oligonucleotide
  modified_base (20)..(21): a, c, g, u, unknown or other
augcaauuaaaagguacaann

SEQ ID NO: 2286 - RNA, 21 nt, Artificial Sequence
  Description of Artificial Sequence: Synthetic oligonucleotide
  modified_base (20)..(21): a, c, g, u, unknown or other
ugcaauuaaaagguacaaunn

SEQ ID NO: 2287 - RNA, 21 nt, Artificial Sequence
  Description of Artificial Sequence: Synthetic oligonucleotide
  modified_base (20)..(21): a, c, g, u, unknown or other
gcaauuaaaagguacaaugnn

SEQ ID NO: 2288 - RNA, 21 nt, Artificial Sequence
  Description of Artificial Sequence: Synthetic oligonucleotide
  modified_base (20)..(21): a, c, g, u, unknown or other
caauuaaaagguacaaugcnn

SEQ ID NO: 2289 - RNA, 21 nt, Artificial Sequence
  Description of Artificial Sequence: Synthetic oligonucleotide
  modified_base (20)..(21): a, c, g, u, unknown or other
aauuaaaagguacaaugcann

SEQ ID NO: 2290 - RNA, 21 nt, Artificial Sequence
  Description of Artificial Sequence: Synthetic oligonucleotide
  modified_base (20)..(21): a, c, g, u, unknown or other
agcccggaggcagcgagcgnn

SEQ ID NO: 2291 - RNA, 21 nt, Artificial Sequence
  Description of Artificial Sequence: Synthetic oligonucleotide
  modified_base (20)..(21): a, c, g, u, unknown or other
gcccggaggcagcgagcggnn

SEQ ID NO: 2292 - DNA, 21 bp, Artificial Sequence
  Description of Artificial Sequence: Synthetic oligonucleotide
  modified_base (20)..(21): a, c, g, u, unknown or other
cccggaggcagcgagcgggnn

SEQ ID NO: 2293 - DNA, 21 bp, Artificial Sequence
  Description of Artificial Sequence: Synthetic oligonucleotide
  modified_base (20)..(21): a, c, g, u, unknown or other
ccggaggcagcgagcggggnn

SEQ ID NO: 2294 - DNA, 21 bp, Artificial Sequence
  Description of Artificial Sequence: Synthetic oligonucleotide
  modified_base (20)..(21): a, c, g, u, unknown or other
cggaggcagcgagcgggggnn

SEQ ID NO: 2295 - DNA, 21 bp, Artificial Sequence
  Description of Artificial Sequence: Synthetic oligonucleotide
  modified_base (20)..(21): a, c, g, u, unknown or other
ggaggcagcgagcggggggnn

SEQ ID NO: 2296 - DNA, 21 bp, Artificial Sequence
  Description of Artificial Sequence: Synthetic oligonucleotide
  modified_base (20)..(21): a, c, g, u, unknown or other
gaggcagcgagcggggggcnn

SEQ ID NO: 2297 - DNA, 21 bp, Artificial Sequence
  Description of Artificial Sequence: Synthetic oligonucleotide
  modified_base (20)..(21): a, c, g, u, unknown or other
aggcagcgagcggggggcunn

SEQ ID NO: 2298 - RNA, 21 nt, Artificial Sequence
  Description of Artificial Sequence: Synthetic oligonucleotide
  modified_base (20)..(21): a, c, g, u, unknown or other
ggcagcgagcggggggcugnn

SEQ ID NO: 2299 - RNA, 21 nt, Artificial Sequence
  Description of Artificial Sequence: Synthetic oligonucleotide
  modified_base (20)..(21): a, c, g, u, unknown or other
gcagcgagcggggggcugcnn

SEQ ID NO: 2300 - RNA, 21 nt, Artificial Sequence
  Description of Artificial Sequence: Synthetic oligonucleotide
  modified_base (20)..(21): a, c, g, u, unknown or other
cagcgagcggggggcugccnn

SEQ ID NO: 2301 - RNA, 21 nt, Artificial Sequence
  Description of Artificial Sequence: Synthetic oligonucleotide
  modified_base (20)..(21): a, c, g, u, unknown or other
agcgagcggggggcugcccnn

SEQ ID NO: 2302 - RNA, 21 nt, Artificial Sequence
  Description of Artificial Sequence: Synthetic oligonucleotide
  modified_base (20)..(21): a, c, g, u, unknown or other
gcgagcggggggcugccccnn

SEQ ID NO: 2303 - RNA, 21 nt, Artificial Sequence
  Description of Artificial Sequence: Synthetic oligonucleotide
  modified_base (20)..(21): a, c, g, u, unknown or other
cgagcggggggcugccccann

SEQ ID NO: 2304 - RNA, 21 nt, Artificial Sequence
  Description of Artificial Sequence: Synthetic oligonucleotide
  modified_base (20)..(21): a, c, g, u, unknown or other
gagcggggggcugccccagnn

SEQ ID NO: 2305 - RNA, 21 nt, Artificial Sequence
  Description of Artificial Sequence: Synthetic oligonucleotide
  modified_base (20)..(21): a, c, g, u, unknown or other
agcggggggcugccccaggnn

SEQ ID NO: 2306 - RNA, 21 nt, Artificial Sequence
  Description of Artificial Sequence: Synthetic oligonucleotide
  modified_base (20)..(21): a, c, g, u, unknown or other
gcggggggcugccccaggcnn

SEQ ID NO: 2307 - RNA, 21 nt, Artificial Sequence
  Description of Artificial Sequence: Synthetic oligonucleotide
  modified_base (20)..(21): a, c, g, u, unknown or other
cggggggcugccccaggcgnn

SEQ ID NO: 2308 - RNA, 21 nt, Artificial Sequence
  Description of Artificial Sequence: Synthetic oligonucleotide
  modified_base (20)..(21): a, c, g, u, unknown or other
ggggggcugccccaggcgcnn

SEQ ID NO: 2309 - RNA, 21 nt, Artificial Sequence
  Description of Artificial Sequence: Synthetic oligonucleotide
  modified_base (20)..(21): a, c, g, u, unknown or other
gggggcugccccaggcgcgnn

SEQ ID NO: 2310 - RNA, 21 nt, Artificial Sequence
  Description of Artificial Sequence: Synthetic oligonucleotide
  modified_base (20)..(21): a, c, g, u, unknown or other
ggggcugccccaggcgcgcnn

SEQ ID NO: 2311 - RNA, 21 nt, Artificial Sequence
  Description of Artificial Sequence: Synthetic oligonucleotide
  modified_base (20)..(21): a, c, g, u, unknown or other
gggcugccccaggcgcgcann

SEQ ID NO: 2312 - RNA, 21 nt, Artificial Sequence
  Description of Artificial Sequence: Synthetic oligonucleotide
  modified_base (20)..(21): a, c, g, u, unknown or other
ggcugccccaggcgcgcaann

SEQ ID NO: 2313 - RNA, 21 nt, Artificial Sequence
  Description of Artificial Sequence: Synthetic oligonucleotide
  modified_base (20)..(21): a, c, g, u, unknown or other
gcugccccaggcgcgcaagnn

SEQ ID NO: 2314 - RNA, 21 nt, Artificial Sequence
  Description of Artificial Sequence: Synthetic oligonucleotide
  modified_base (20)..(21): a, c, g, u, unknown or other
cugccccaggcgcgcaagcnn

SEQ ID NO: 2315 - RNA, 21 nt, Artificial Sequence
  Description of Artificial Sequence: Synthetic oligonucleotide
  modified_base (20)..(21): a, c, g, u, unknown or other
ugccccaggcgcgcaagcgnn

SEQ ID NO: 2316 - RNA, 21 nt, Artificial Sequence
  Description of Artificial Sequence: Synthetic oligonucleotide
  modified_base (20)..(21): a, c, g, u, unknown or other
cugagccccgaggagaaggnn

SEQ ID NO: 2317 - RNA, 21 nt, Artificial Sequence
  Description of Artificial Sequence: Synthetic oligonucleotide
  modified_base (20)..(21): a, c, g, u, unknown or other
ugagccccgaggagaaggcnn

SEQ ID NO: 2318 - RNA, 21 nt, Artificial Sequence
  Description of Artificial Sequence: Synthetic oligonucleotide
  modified_base (20)..(21): a, c, g, u, unknown or other
gagccccgaggagaaggcgnn

SEQ ID NO: 2319 - RNA, 21 nt, Artificial Sequence
  Description of Artificial Sequence: Synthetic oligonucleotide
  modified_base (20)..(21): a, c, g, u, unknown or other
agccccgaggagaaggcgcnn

SEQ ID NO: 2320 - DNA, 21 bp, Artificial Sequence
  Description of Artificial Sequence: Synthetic oligonucleotide
  modified_base (20)..(21): a, c, g, u, unknown or other
gccccgaggagaaggcgcunn

SEQ ID NO: 2321 - RNA, 21 nt, Artificial Sequence
  Description of Artificial Sequence: Synthetic oligonucleotide
  modified_base (20)..(21): a, c, g, u, unknown or other
ccccgaggagaaggcgcugnn

SEQ ID NO: 2322 - RNA, 21 nt, Artificial Sequence
  Description of Artificial Sequence: Synthetic oligonucleotide
  modified_base (20)..(21): a, c, g, u, unknown or other
cccgaggagaaggcgcugann

SEQ ID NO: 2323 - RNA, 21 nt, Artificial Sequence
  Description of Artificial Sequence: Synthetic oligonucleotide
  modified_base (20)..(21): a, c, g, u, unknown or other
ccgaggagaaggcgcugagnn

SEQ ID NO: 2324 - RNA, 21 nt, Artificial Sequence
  Description of Artificial Sequence: Synthetic oligonucleotide
  modified_base (20)..(21): a, c, g, u, unknown or other
cgaggagaaggcgcugaggnn

SEQ ID NO: 2325 - RNA, 21 nt, Artificial Sequence
  Description of Artificial Sequence: Synthetic oligonucleotide
  modified_base (20)..(21): a, c, g, u, unknown or other
gaggagaaggcgcugaggann

SEQ ID NO: 2326 - RNA, 21 nt, Artificial Sequence
  Description of Artificial Sequence: Synthetic oligonucleotide
  modified_base (20)..(21): a, c, g, u, unknown or other
aggagaaggcgcugaggagnn

SEQ ID NO: 2327 - RNA, 21 nt, Artificial Sequence
  Description of Artificial Sequence: Synthetic oligonucleotide
  modified_base (20)..(21): a, c, g, u, unknown or other
ggagaaggcgcugaggaggnn

SEQ ID NO: 2328 - RNA, 21 nt, Artificial Sequence
  Description of Artificial Sequence: Synthetic oligonucleotide
  modified_base (20)..(21): a, c, g, u, unknown or other
gagaaggcgcugaggaggann

SEQ ID NO: 2329 - RNA, 21 nt, Artificial Sequence
  Description of Artificial Sequence: Synthetic oligonucleotide
  modified_base (20)..(21): a, c, g, u, unknown or other
agaaggcgcugaggaggaann

SEQ ID NO: 2330 - RNA, 21 nt, Artificial Sequence
  Description of Artificial Sequence: Synthetic oligonucleotide
  modified_base (20)..(21): a, c, g, u, unknown or other
gaaggcgcugaggaggaaann

SEQ ID NO: 2331 - RNA, 21 nt, Artificial Sequence
  Description of Artificial Sequence: Synthetic oligonucleotide
  modified_base (20)..(21): a, c, g, u, unknown or other
aaggcgcugaggaggaaacnn

SEQ ID NO: 2332 - RNA, 21 nt, Artificial Sequence
  Description of Artificial Sequence: Synthetic oligonucleotide
  modified_base (20)..(21): a, c, g, u, unknown or other
aggcgcugaggaggaaacunn

SEQ ID NO: 2333 - RNA, 21 nt, Artificial Sequence
  Description of Artificial Sequence: Synthetic oligonucleotide
  modified_base (20)..(21): a, c, g, u, unknown or other
ggcgcugaggaggaaacugnn

SEQ ID NO: 2334 - RNA, 21 nt, Artificial Sequence
  Description of Artificial Sequence: Synthetic oligonucleotide
  modified_base (20)..(21): a, c, g, u, unknown or other
gcgcugaggaggaaacugann

SEQ ID NO: 2335 - RNA, 21 nt, Artificial Sequence
  Description of Artificial Sequence: Synthetic oligonucleotide
  modified_base (20)..(21): a, c, g, u, unknown or other
cgcugaggaggaaacugaann

SEQ ID NO: 2336 - RNA, 21 nt, Artificial Sequence
  Description of Artificial Sequence: Synthetic oligonucleotide
  modified_base (20)..(21): a, c, g, u, unknown or other
gcugaggaggaaacugaaann

SEQ ID NO: 2337 - RNA, 21 nt, Artificial Sequence
  Description of Artificial Sequence: Synthetic oligonucleotide
  modified_base (20)..(21): a, c, g, u, unknown or other
cugaggaggaaacugaaaann

SEQ ID NO: 2338 - RNA, 21 nt, Artificial Sequence
  Description of Artificial Sequence: Synthetic oligonucleotide
  modified_base (20)..(21): a, c, g, u, unknown or other
ugaggaggaaacugaaaaann

SEQ ID NO: 2339 - RNA, 21 nt, Artificial Sequence
  Description of Artificial Sequence: Synthetic oligonucleotide
  modified_base (20)..(21): a, c, g, u, unknown or other
gaggaggaaacugaaaaacnn

SEQ ID NO: 2340 - RNA, 21 nt, Artificial Sequence
  Description of Artificial Sequence: Synthetic oligonucleotide
  modified_base (20)..(21): a, c, g, u, unknown or other
aggaggaaacugaaaaacann

SEQ ID NO: 2341 - RNA, 21 nt, Artificial Sequence
  Description of Artificial Sequence: Synthetic oligonucleotide
  modified_base (20)..(21): a, c, g, u, unknown or other
ggaggaaacugaaaaacagnn

SEQ ID NO: 2342 - RNA, 21 nt, Artificial Sequence
  Description of Artificial Sequence: Synthetic oligonucleotide
  modified_base (20)..(21): a, c, g, u, unknown or other
gaggaaacugaaaaacagann

SEQ ID NO: 2343 - RNA, 21 nt, Artificial Sequence
  Description of Artificial Sequence: Synthetic oligonucleotide
  modified_base (20)..(21): a, c, g, u, unknown or other
aggaaacugaaaaacagagnn

SEQ ID NO: 2344 - RNA, 21 nt, Artificial Sequence
  Description of Artificial Sequence: Synthetic oligonucleotide
  modified_base (20)..(21): a, c, g, u, unknown or other
ggaaacugaaaaacagagunn

SEQ ID NO: 2345 - RNA, 21 nt, Artificial Sequence
  Description of Artificial Sequence: Synthetic oligonucleotide
  modified_base (20)..(21): a, c, g, u, unknown or other
gaaacugaaaaacagaguann

SEQ ID NO: 2346 - RNA, 21 nt, Artificial Sequence
  Description of Artificial Sequence: Synthetic oligonucleotide
  modified_base (20)..(21): a, c, g, u, unknown or other
aaacugaaaaacagaguagnn

SEQ ID NO: 2347 - RNA, 21 nt, Artificial Sequence
  Description of Artificial Sequence: Synthetic oligonucleotide
  modified_base (20)..(21): a, c, g, u, unknown or other
aacugaaaaacagaguagcnn

SEQ ID NO: 2348 - RNA, 21 nt, Artificial Sequence
  Description of Artificial Sequence: Synthetic oligonucleotide
  modified_base (20)..(21): a, c, g, u, unknown or other
acugaaaaacagaguagcann

SEQ ID NO: 2349 - RNA, 21 nt, Artificial Sequence
  Description of Artificial Sequence: Synthetic oligonucleotide
  modified_base (20)..(21): a, c, g, u, unknown or other
cugaaaaacagaguagcagnn

SEQ ID NO: 2350 - RNA, 21 nt, Artificial Sequence
  Description of Artificial Sequence: Synthetic oligonucleotide
  modified_base (20)..(21): a, c, g, u, unknown or other
ugaaaaacagaguagcagcnn

SEQ ID NO: 2351 - RNA, 21 nt, Artificial Sequence
  Description of Artificial Sequence: Synthetic oligonucleotide
  modified_base (20)..(21): a, c, g, u, unknown or other
gaaaaacagaguagcagcunn

SEQ ID NO: 2352 - RNA, 21 nt, Artificial Sequence
  Description of Artificial Sequence: Synthetic oligonucleotide
  modified_base (20)..(21): a, c, g, u, unknown or other
aaaaacagaguagcagcucnn

SEQ ID NO: 2353 - RNA, 21 nt, Artificial Sequence
  Description of Artificial Sequence: Synthetic oligonucleotide
  modified_base (20)..(21): a, c, g, u, unknown or other
aaaacagaguagcagcucann

SEQ ID NO: 2354 - RNA, 21 nt, Artificial Sequence
  Description of Artificial Sequence: Synthetic oligonucleotide
  modified_base (20)..(21): a, c, g, u, unknown or other
aaacagaguagcagcucagnn

SEQ ID NO: 2355 - RNA, 21 nt, Artificial Sequence
  Description of Artificial Sequence: Synthetic oligonucleotide
  modified_base (20)..(21): a, c, g, u, unknown or other
aacagaguagcagcucagann

SEQ ID NO: 2356 - RNA, 21 nt, Artificial Sequence
  Description of Artificial Sequence: Synthetic oligonucleotide
  modified_base (20)..(21): a, c, g, u, unknown or other
acagaguagcagcucagacnn

SEQ ID NO: 2357 - RNA, 21 nt, Artificial Sequence
  Description of Artificial Sequence: Synthetic oligonucleotide
  modified_base (20)..(21): a, c, g, u, unknown or other
cagaguagcagcucagacunn

SEQ ID NO: 2358 - RNA, 21 nt, Artificial Sequence
  Description of Artificial Sequence: Synthetic oligonucleotide
  modified_base (20)..(21): a, c, g, u, unknown or other
agaguagcagcucagacugnn

SEQ ID NO: 2359 - RNA, 21 nt, Artificial Sequence
  Description of Artificial Sequence: Synthetic oligonucleotide
  modified_base (20)..(21): a, c, g, u, unknown or other
gaguagcagcucagacugcnn

SEQ ID NO: 2360 - RNA, 21 nt, Artificial Sequence
  Description of Artificial Sequence: Synthetic oligonucleotide
  modified_base (20)..(21): a, c, g, u, unknown or other
aguagcagcucagacugccnn

SEQ ID NO: 2361 - RNA, 21 nt, Artificial Sequence
  Description of Artificial Sequence: Synthetic oligonucleotide
  modified_base (20)..(21): a, c, g, u, unknown or other
guagcagcucagacugccann

SEQ ID NO: 2362 - RNA, 21 nt, Artificial Sequence
  Description of Artificial Sequence: Synthetic oligonucleotide
  modified_base (20)..(21): a, c, g, u, unknown or other
uagcagcucagacugccagnn

SEQ ID NO: 2363 - RNA, 21 nt, Artificial Sequence
  Description of Artificial Sequence: Synthetic oligonucleotide
  modified_base (20)..(21): a, c, g, u, unknown or other
agcagcucagacugccagann

SEQ ID NO: 2364 - RNA, 21 nt, Artificial Sequence
  Description of Artificial Sequence: Synthetic oligonucleotide
  modified_base (20)..(21): a, c, g, u, unknown or other
gcagcucagacugccagagnn

SEQ ID NO: 2365 - RNA, 21 nt, Artificial Sequence
  Description of Artificial Sequence: Synthetic oligonucleotide
  modified_base (20)..(21): a, c, g, u, unknown or other
cagcucagacugccagagann

SEQ ID NO: 2366 - RNA, 21 nt, Artificial Sequence
  Description of Artificial Sequence: Synthetic oligonucleotide
  modified_base (20)..(21): a, c, g, u, unknown or other
agcucagacugccagagaunn

SEQ ID NO: 2367 - RNA, 21 nt, Artificial Sequence
  Description of Artificial Sequence: Synthetic oligonucleotide
  modified_base (20)..(21): a, c, g, u, unknown or other
gcucagacugccagagaucnn

SEQ ID NO: 2368 - RNA, 21 nt, Artificial Sequence
  Description of Artificial Sequence: Synthetic oligonucleotide
  modified_base (20)..(21): a, c, g, u, unknown or other
cucagacugccagagaucgnn

SEQ ID NO: 2369 - RNA, 21 nt, Artificial Sequence
  Description of Artificial Sequence: Synthetic oligonucleotide
  modified_base (20)..(21): a, c, g, u, unknown or other
ucagacugccagagaucgann

SEQ ID NO: 2370 - RNA, 21 nt, Artificial Sequence
  Description of Artificial Sequence: Synthetic oligonucleotide
  modified_base (20)..(21): a, c, g, u, unknown or other
cagacugccagagaucgaann

SEQ ID NO: 2371 - RNA, 21 nt, Artificial Sequence
  Description of Artificial Sequence: Synthetic oligonucleotide
  modified_base (20)..(21): a, c, g, u, unknown or other
agacugccagagaucgaaann

SEQ ID NO: 2372 - RNA, 21 nt, Artificial Sequence
  Description of Artificial Sequence: Synthetic oligonucleotide
  modified_base (20)..(21): a, c, g, u, unknown or other
gacugccagagaucgaaagnn

SEQ ID NO: 2373 - RNA, 21 nt, Artificial Sequence
  Description of Artificial Sequence: Synthetic oligonucleotide
  modified_base (20)..(21): a, c, g, u, unknown or other
acugccagagaucgaaagann

SEQ ID NO: 2374 - RNA, 21 nt, Artificial Sequence
  Description of Artificial Sequence: Synthetic oligonucleotide
  modified_base (20)..(21): a, c, g, u, unknown or other
cugccagagaucgaaagaann

SEQ ID NO: 2375 - RNA, 21 nt, Artificial Sequence
  Description of Artificial Sequence: Synthetic oligonucleotide
  modified_base (20)..(21): a, c, g, u, unknown or other
gcucgaaugagugagcuggnn

SEQ ID NO: 2376 - RNA, 21 nt, Artificial Sequence
  Description of Artificial Sequence: Synthetic oligonucleotide
  modified_base (20)..(21): a, c, g, u, unknown or other
cucgaaugagugagcuggann

SEQ ID NO: 2377 - RNA, 21 nt, Artificial Sequence
  Description of Artificial Sequence: Synthetic oligonucleotide
  modified_base (20)..(21): a, c, g, u, unknown or other
ucgaaugagugagcuggaann

SEQ ID NO: 2378 - RNA, 21 nt, Artificial Sequence
  Description of Artificial Sequence: Synthetic oligonucleotide
  modified_base (20)..(21): a, c, g, u, unknown or other
cgaaugagugagcuggaacnn

SEQ ID NO: 2379 - RNA, 21 nt, Artificial Sequence
  Description of Artificial Sequence: Synthetic oligonucleotide
  modified_base (20)..(21): a, c, g, u, unknown or other
gaaugagugagcuggaacann

SEQ ID NO: 2380 - RNA, 21 nt, Artificial Sequence
  Description of Artificial Sequence: Synthetic oligonucleotide
  modified_base (20)..(21): a, c, g, u, unknown or other
aaugagugagcuggaacagnn

SEQ ID NO: 2381 - RNA, 21 nt, Artificial Sequence
  Description of Artificial Sequence: Synthetic oligonucleotide
  modified_base (20)..(21): a, c, g, u, unknown or other
augagugagcuggaacagcnn

SEQ ID NO: 2382 - RNA, 21 nt, Artificial Sequence
  Description of Artificial Sequence: Synthetic oligonucleotide
  modified_base (20)..(21): a, c, g, u, unknown or other
ugagugagcuggaacagcann

SEQ ID NO: 2383 - RNA, 21 nt, Artificial Sequence
  Description of Artificial Sequence: Synthetic oligonucleotide
  modified_base (20)..(21): a, c, g, u, unknown or other
gagugagcuggaacagcaann

SEQ ID NO: 2384 - RNA, 21 nt, Artificial Sequence
  Description of Artificial Sequence: Synthetic oligonucleotide
  modified_base (20)..(21): a, c, g, u, unknown or other
agugagcuggaacagcaagnn

SEQ ID NO: 2385 - RNA, 21 nt, Artificial Sequence
  Description of Artificial Sequence: Synthetic oligonucleotide
  modified_base (20)..(21): a, c, g, u, unknown or other
gugagcuggaacagcaagunn

SEQ ID NO: 2386 - RNA, 21 nt, Artificial Sequence
  Description of Artificial Sequence: Synthetic oligonucleotide
  modified_base (20)..(21): a, c, g, u, unknown or other
ugagcuggaacagcaagugnn

SEQ ID NO: 2387 - RNA, 21 nt, Artificial Sequence
  Description of Artificial Sequence: Synthetic oligonucleotide
  modified_base (20)..(21): a, c, g, u, unknown or other
gagcuggaacagcaaguggnn

SEQ ID NO: 2388 - RNA, 21 nt, Artificial Sequence
  Description of Artificial Sequence: Synthetic oligonucleotide
  modified_base (20)..(21): a, c, g, u, unknown or other
agcuggaacagcaaguggunn

SEQ ID NO: 2389 - RNA, 21 nt, Artificial Sequence
  Description of Artificial Sequence: Synthetic oligonucleotide
  modified_base (20)..(21): a, c, g, u, unknown or other
gcuggaacagcaagugguann

SEQ ID NO: 2390 - RNA, 21 nt, Artificial Sequence
  Description of Artificial Sequence: Synthetic oligonucleotide
  modified_base (20)..(21): a, c, g, u, unknown or other
cuggaacagcaagugguagnn

SEQ ID NO: 2391 - RNA, 21 nt, Artificial Sequence
  Description of Artificial Sequence: Synthetic oligonucleotide
  modified_base (20)..(21): a, c, g, u, unknown or other
uggaacagcaagugguagann

SEQ ID NO: 2392 - RNA, 21 nt, Artificial Sequence
  Description of Artificial Sequence: Synthetic oligonucleotide
  modified_base (20)..(21): a, c, g, u, unknown or other
ggaacagcaagugguagaunn

SEQ ID NO: 2393 - RNA, 21 nt, Artificial Sequence
  Description of Artificial Sequence: Synthetic oligonucleotide
  modified_base (20)..(21): a, c, g, u, unknown or other
gaacagcaagugguagauunn

SEQ ID NO: 2394 - RNA, 21 nt, Artificial Sequence
  Description of Artificial Sequence: Synthetic oligonucleotide
  modified_base (20)..(21): a, c, g, u, unknown or other
aacagcaagugguagauuunn

SEQ ID NO: 2395 - RNA, 21 nt, Artificial Sequence
  Description of Artificial Sequence: Synthetic oligonucleotide
  modified_base (20)..(21): a, c, g, u, unknown or other
acagcaagugguagauuuann

SEQ ID NO: 2396 - RNA, 21 nt, Artificial Sequence
  Description of Artificial Sequence: Synthetic oligonucleotide
  modified_base (20)..(21): a, c, g, u, unknown or other
cagcaagugguagauuuagnn

SEQ ID NO: 2397 - RNA, 21 nt, Artificial Sequence
  Description of Artificial Sequence: Synthetic oligonucleotide
  modified_base (20)..(21): a, c, g, u, unknown or other
agcaagugguagauuuagann

SEQ ID NO: 2398 - RNA, 21 nt, Artificial Sequence
  Description of Artificial Sequence: Synthetic oligonucleotide
  modified_base (20)..(21): a, c, g, u, unknown or other
gcaagugguagauuuagaann

SEQ ID NO: 2399 - RNA, 21 nt, Artificial Sequence
  Description of Artificial Sequence: Synthetic oligonucleotide
  modified_base (20)..(21): a, c, g, u, unknown or other
caagugguagauuuagaagnn

SEQ ID NO: 2400 - RNA, 21 nt, Artificial Sequence
  Description of Artificial Sequence: Synthetic oligonucleotide
  modified_base (20)..(21): a, c, g, u, unknown or other
aagugguagauuuagaagann

SEQ ID NO: 2401 - RNA, 21 nt, Artificial Sequence
  Description of Artificial Sequence: Synthetic oligonucleotide
  modified_base (20)..(21): a, c, g, u, unknown or other
agugguagauuuagaagaann

SEQ ID NO: 2402 - RNA, 21 nt, Artificial Sequence
  Description of Artificial Sequence: Synthetic oligonucleotide
  modified_base (20)..(21): a, c, g, u, unknown or other
gugguagauuuagaagaagnn

SEQ ID NO: 2403 - RNA, 21 nt, Artificial Sequence
  Description of Artificial Sequence: Synthetic oligonucleotide
  modified_base (20)..(21): a, c, g, u, unknown or other
ugguagauuuagaagaagann

SEQ ID NO: 2404 - RNA, 21 nt, Artificial Sequence
  Description of Artificial Sequence: Synthetic oligonucleotide
  modified_base (20)..(21): a, c, g, u, unknown or other
gguagauuuagaagaagagnn

SEQ ID NO: 2405 - RNA, 21 nt, Artificial Sequence
  Description of Artificial Sequence: Synthetic oligonucleotide
  modified_base (20)..(21): a, c, g, u, unknown or other
guagauuuagaagaagagann

SEQ ID NO: 2406 - RNA, 21 nt, Artificial Sequence
  Description of Artificial Sequence: Synthetic oligonucleotide
  modified_base (20)..(21): a, c, g, u, unknown or other
uagauuuagaagaagagaann

SEQ ID NO: 2407 - RNA, 21 nt, Artificial Sequence
  Description of Artificial Sequence: Synthetic oligonucleotide
  modified_base (20)..(21): a, c, g, u, unknown or other
agauuuagaagaagagaacnn

SEQ ID NO: 2408 - RNA, 21 nt, Artificial Sequence
  Description of Artificial Sequence: Synthetic oligonucleotide
  modified_base (20)..(21): a, c, g, u, unknown or other
gauuuagaagaagagaaccnn

SEQ ID NO: 2409 - RNA, 21 nt, Artificial Sequence
  Description of Artificial Sequence: Synthetic oligonucleotide
  modified_base (20)..(21): a, c, g, u, unknown or other
auuuagaagaagagaaccann

SEQ ID NO: 2410 - RNA, 21 nt, Artificial Sequence
  Description of Artificial Sequence: Synthetic oligonucleotide
  modified_base (20)..(21): a, c, g, u, unknown or other
uuuagaagaagagaaccaann

SEQ ID NO: 2411 - RNA, 21 nt, Artificial Sequence
  Description of Artificial Sequence: Synthetic oligonucleotide
  modified_base (20)..(21): a, c, g, u, unknown or other
uuagaagaagagaaccaaann

SEQ ID NO: 2412 - RNA, 21 nt, Artificial Sequence
  Description of Artificial Sequence: Synthetic oligonucleotide
  modified_base (20)..(21): a, c, g, u, unknown or other
uagaagaagagaaccaaaann

SEQ ID NO: 2413 - RNA, 21 nt, Artificial Sequence
  Description of Artificial Sequence: Synthetic oligonucleotide
  modified_base (20)..(21): a, c, g, u, unknown or other
agaagaagagaaccaaaaann

SEQ ID NO: 2414 - RNA, 21 nt, Artificial Sequence
  Description of Artificial Sequence: Synthetic oligonucleotide
  modified_base (20)..(21): a, c, g, u, unknown or other
gaagaagagaaccaaaaacnn

SEQ ID NO: 2415 - DNA, 21 bp, Artificial Sequence
  Description of Artificial Sequence: Synthetic oligonucleotide
  modified_base (20)..(21): a, c, g, u, unknown or other
aagaagagaaccaaaaacunn

SEQ ID NO: 2416 - RNA, 21 nt, Artificial Sequence
  Description of Artificial Sequence: Synthetic oligonucleotide
  modified_base (20)..(21): a, c, g, u, unknown or other
agaagagaaccaaaaacuunn

SEQ ID NO: 2417 - RNA, 21 nt, Artificial Sequence
  Description of Artificial Sequence: Synthetic oligonucleotide
  modified_base (20)..(21): a, c, g, u, unknown or other
gaagagaaccaaaaacuuunn

SEQ ID NO: 2418 - RNA, 21 nt, Artificial Sequence
  Description of Artificial Sequence: Synthetic oligonucleotide
  modified_base (20)..(21): a, c, g, u, unknown or other
aagagaaccaaaaacuuuunn

SEQ ID NO: 2419 - RNA, 21 nt, Artificial Sequence
  Description of Artificial Sequence: Synthetic oligonucleotide
  modified_base (20)..(21): a, c, g, u, unknown or other
agagaaccaaaaacuuuugnn

SEQ ID NO: 2420 - RNA, 21 nt, Artificial Sequence
  Description of Artificial Sequence: Synthetic oligonucleotide
  modified_base (20)..(21): a, c, g, u, unknown or other
gagaaccaaaaacuuuugcnn

SEQ ID NO: 2421 - RNA, 21 nt, Artificial Sequence
  Description of Artificial Sequence: Synthetic oligonucleotide
  modified_base (20)..(21): a, c, g, u, unknown or other
agaaccaaaaacuuuugcunn

SEQ ID NO: 2422 - RNA, 21 nt, Artificial Sequence
  Description of Artificial Sequence: Synthetic oligonucleotide
  modified_base (20)..(21): a, c, g, u, unknown or other
gaaccaaaaacuuuugcuann

SEQ ID NO: 2423 - RNA, 21 nt, Artificial Sequence
  Description of Artificial Sequence: Synthetic oligonucleotide
  modified_base (20)..(21): a, c, g, u, unknown or other
aaccaaaaacuuuugcuagnn

SEQ ID NO: 2424 - RNA, 21 nt, Artificial Sequence
  Description of Artificial Sequence: Synthetic oligonucleotide
  modified_base (20)..(21): a, c, g, u, unknown or other
accaaaaacuuuugcuagann

SEQ ID NO: 2425 - RNA, 21 nt, Artificial Sequence
  Description of Artificial Sequence: Synthetic oligonucleotide
  modified_base (20)..(21): a, c, g, u, unknown or other
ccaaaaacuuuugcuagaann

SEQ ID NO: 2426 - RNA, 21 nt, Artificial Sequence
  Description of Artificial Sequence: Synthetic oligonucleotide
  modified_base (20)..(21): a, c, g, u, unknown or other
caaaaacuuuugcuagaaann

SEQ ID NO: 2427 - RNA, 21 nt, Artificial Sequence
  Description of Artificial Sequence: Synthetic oligonucleotide
  modified_base (20)..(21): a, c, g, u, unknown or other
aaaaacuuuugcuagaaaann

SEQ ID NO: 2428 - RNA, 21 nt, Artificial Sequence
  Description of Artificial Sequence: Synthetic oligonucleotide
  modified_base (20)..(21): a, c, g, u, unknown or other
aaaacuuuugcuagaaaaunn

SEQ ID NO: 2429 - RNA, 21 nt, Artificial Sequence
  Description of Artificial Sequence: Synthetic oligonucleotide
  modified_base (20)..(21): a, c, g, u, unknown or other
aaacuuuugcuagaaaaucnn

SEQ ID NO: 2430 - RNA, 21 nt, Artificial Sequence
  Description of Artificial Sequence: Synthetic oligonucleotide
  modified_base (20)..(21): a, c, g, u, unknown or other
aacuuuugcuagaaaaucann

SEQ ID NO: 2431 - RNA, 21 nt, Artificial Sequence
  Description of Artificial Sequence: Synthetic oligonucleotide
  modified_base (20)..(21): a, c, g, u, unknown or other
acuuuugcuagaaaaucagnn

SEQ ID NO: 2432 - RNA, 21 nt, Artificial Sequence
  Description of Artificial Sequence: Synthetic oligonucleotide
  modified_base (20)..(21): a, c, g, u, unknown or other
cuuuugcuagaaaaucagcnn

SEQ ID NO: 2433 - RNA, 21 nt, Artificial Sequence
  Description of Artificial Sequence: Synthetic oligonucleotide
  modified_base (20)..(21): a, c, g, u, unknown or other
uuuugcuagaaaaucagcunn

SEQ ID NO: 2434 - RNA, 21 nt, Artificial Sequence
  Description of Artificial Sequence: Synthetic oligonucleotide
  modified_base (20)..(21): a, c, g, u, unknown or other
uuugcuagaaaaucagcuunn

SEQ ID NO: 2435 - RNA, 21 nt, Artificial Sequence
  Description of Artificial Sequence: Synthetic oligonucleotide
  modified_base (20)..(21): a, c, g, u, unknown or other
uugcuagaaaaucagcuuunn

SEQ ID NO: 2436 - RNA, 21 nt, Artificial Sequence
  Description of Artificial Sequence: Synthetic oligonucleotide
  modified_base (20)..(21): a, c, g, u, unknown or other
ugcuagaaaaucagcuuuunn

SEQ ID NO: 2437 - RNA, 21 nt, Artificial Sequence
  Description of Artificial Sequence: Synthetic oligonucleotide
  modified_base (20)..(21): a, c, g, u, unknown or other
gcuagaaaaucagcuuuuann

SEQ ID NO: 2438 - RNA, 21 nt, Artificial Sequence
  Description of Artificial Sequence: Synthetic oligonucleotide
  modified_base (20)..(21): a, c, g, u, unknown or other
cuagaaaaucagcuuuuacnn

SEQ ID NO: 2439 - RNA, 21 nt, Artificial Sequence
  Description of Artificial Sequence: Synthetic oligonucleotide
  modified_base (20)..(21): a, c, g, u, unknown or other
uagaaaaucagcuuuuacgnn

SEQ ID NO: 2440 - RNA, 21 nt, Artificial Sequence
  Description of Artificial Sequence: Synthetic oligonucleotide
  modified_base (20)..(21): a, c, g, u, unknown or other
agaaaaucagcuuuuacgann

SEQ ID NO: 2441 - RNA, 21 nt, Artificial Sequence
  Description of Artificial Sequence: Synthetic oligonucleotide
  modified_base (20)..(21): a, c, g, u, unknown or other
gaaaaucagcuuuuacgagnn

SEQ ID NO: 2442 - RNA, 21 nt, Artificial Sequence
  Description of Artificial Sequence: Synthetic oligonucleotide
  modified_base (20)..(21): a, c, g, u, unknown or other
aaaaucagcuuuuacgagann

SEQ ID NO: 2443 - RNA, 21 nt, Artificial Sequence
  Description of Artificial Sequence: Synthetic oligonucleotide
  modified_base (20)..(21): a, c, g, u, unknown or other
aaaucagcuuuuacgagagnn

SEQ ID NO: 2444 - RNA, 21 nt, Artificial Sequence
  Description of Artificial Sequence: Synthetic oligonucleotide
  modified_base (20)..(21): a, c, g, u, unknown or other
aaucagcuuuuacgagagann

SEQ ID NO: 2445 - RNA, 21 nt, Artificial Sequence
  Description of Artificial Sequence: Synthetic oligonucleotide
  modified_base (20)..(21): a, c, g, u, unknown or other
aucagcuuuuacgagagaann

SEQ ID NO: 2446 - RNA, 21 nt, Artificial Sequence
  Description of Artificial Sequence: Synthetic oligonucleotide
  modified_base (20)..(21): a, c, g, u, unknown or other
ucagcuuuuacgagagaaann

SEQ ID NO: 2447 - RNA, 21 nt, Artificial Sequence
  Description of Artificial Sequence: Synthetic oligonucleotide
  modified_base (20)..(21): a, c, g, u, unknown or other
cagcuuuuacgagagaaaann

SEQ ID NO: 2448 - RNA, 21 nt, Artificial Sequence
  Description of Artificial Sequence: Synthetic oligonucleotide
  modified_base (20)..(21): a, c, g, u, unknown or other
agcuuuuacgagagaaaacnn

SEQ ID NO: 2449 - RNA, 21 nt, Artificial Sequence
  Description of Artificial Sequence: Synthetic oligonucleotide
  modified_base (20)..(21): a, c, g, u, unknown or other
gcuuuuacgagagaaaacunn

SEQ ID NO: 2450 - RNA, 21 nt, Artificial Sequence
  Description of Artificial Sequence: Synthetic oligonucleotide
  modified_base (20)..(21): a, c, g, u, unknown or other
cuuuuacgagagaaaacucnn

SEQ ID NO: 2451 - RNA, 21 nt, Artificial Sequence
  Description of Artificial Sequence: Synthetic oligonucleotide
  modified_base (20)..(21): a, c, g, u, unknown or other
uuuuacgagagaaaacucann

SEQ ID NO: 2452 - RNA, 21 nt, Artificial Sequence
  Description of Artificial Sequence: Synthetic oligonucleotide
  modified_base (20)..(21): a, c, g, u, unknown or other
ggccuuguaguugagaaccnn

SEQ ID NO: 2453 - RNA, 21 nt, Artificial Sequence
  Description of Artificial Sequence: Synthetic oligonucleotide
  modified_base (20)..(21): a, c, g, u, unknown or other
gccuuguaguugagaaccann

SEQ ID NO: 2454 - RNA, 21 nt, Artificial Sequence
  Description of Artificial Sequence: Synthetic oligonucleotide
  modified_base (20)..(21): a, c, g, u, unknown or other
ccuuguaguugagaaccagnn

SEQ ID NO: 2455 - RNA, 21 nt, Artificial Sequence
  Description of Artificial Sequence: Synthetic oligonucleotide
  modified_base (20)..(21): a, c, g, u, unknown or other
cuuguaguugagaaccaggnn

SEQ ID NO: 2456 - RNA, 21 nt, Artificial Sequence
  Description of Artificial Sequence: Synthetic oligonucleotide
  modified_base (20)..(21): a, c, g, u, unknown or other
uuguaguugagaaccaggann

SEQ ID NO: 2457 - RNA, 21 nt, Artificial Sequence
  Description of Artificial Sequence: Synthetic oligonucleotide
  modified_base (20)..(21): a, c, g, u, unknown or other
uguaguugagaaccaggagnn

SEQ ID NO: 2458 - RNA, 21 nt, Artificial Sequence
  Description of Artificial Sequence: Synthetic oligonucleotide
  modified_base (20)..(21): a, c, g, u, unknown or other
guaguugagaaccaggagunn

SEQ ID NO: 2459 - RNA, 21 nt, Artificial Sequence
  Description of Artificial Sequence: Synthetic oligonucleotide
  modified_base (20)..(21): a, c, g, u, unknown or other
uaguugagaaccaggaguunn

SEQ ID NO: 2460 - RNA, 21 nt, Artificial Sequence
  Description of Artificial Sequence: Synthetic oligonucleotide
  modified_base (20)..(21): a, c, g, u, unknown or other
aguugagaaccaggaguuann

SEQ ID NO: 2461 - RNA, 21 nt, Artificial Sequence
  Description of Artificial Sequence: Synthetic oligonucleotide
  modified_base (20)..(21): a, c, g, u, unknown or other
guugagaaccaggaguuaann

SEQ ID NO: 2462 - RNA, 21 nt, Artificial Sequence
  Description of Artificial Sequence: Synthetic oligonucleotide
  modified_base (20)..(21): a, c, g, u, unknown or other
uugagaaccaggaguuaagnn

SEQ ID NO: 2463 - RNA, 21 nt, Artificial Sequence
  Description of Artificial Sequence: Synthetic oligonucleotide
  modified_base (20)..(21): a, c, g, u, unknown or other
ugagaaccaggaguuaagann

SEQ ID NO: 2464 - RNA, 21 nt, Artificial Sequence
  Description of Artificial Sequence: Synthetic oligonucleotide
  modified_base (20)..(21): a, c, g, u, unknown or other
gagaaccaggaguuaagacnn

SEQ ID NO: 2465 - RNA, 21 nt, Artificial Sequence
  Description of Artificial Sequence: Synthetic oligonucleotide
  modified_base (20)..(21): a, c, g, u, unknown or other
agaaccaggaguuaagacann

SEQ ID NO: 2466 - RNA, 21 nt, Artificial Sequence
  Description of Artificial Sequence: Synthetic oligonucleotide
  modified_base (20)..(21): a, c, g, u, unknown or other
gaaccaggaguuaagacagnn

SEQ ID NO: 2467 - RNA, 21 nt, Artificial Sequence
  Description of Artificial Sequence: Synthetic oligonucleotide
  modified_base (20)..(21): a, c, g, u, unknown or other
aaccaggaguuaagacagcnn

SEQ ID NO: 2468 - RNA, 21 nt, Artificial Sequence
  Description of Artificial Sequence: Synthetic oligonucleotide
  modified_base (20)..(21): a, c, g, u, unknown or other
accaggaguuaagacagcgnn

SEQ ID NO: 2469 - RNA, 21 nt, Artificial Sequence
  Description of Artificial Sequence: Synthetic oligonucleotide
  modified_base (20)..(21): a, c, g, u, unknown or other
ccaggaguuaagacagcgcnn

SEQ ID NO: 2470 - RNA, 21 nt, Artificial Sequence
  Description of Artificial Sequence: Synthetic oligonucleotide
  modified_base (20)..(21): a, c, g, u, unknown or other
gagcuaugguggugguggcnn

SEQ ID NO: 2471 - RNA, 21 nt, Artificial Sequence
  Description of Artificial Sequence: Synthetic oligonucleotide
  modified_base (20)..(21): a, c, g, u, unknown or other
agcuaugguggugguggcann

SEQ ID NO: 2472 - RNA, 21 nt, Artificial Sequence
  Description of Artificial Sequence: Synthetic oligonucleotide
  modified_base (20)..(21): a, c, g, u, unknown or other
uggggauggaugcccuggunn

SEQ ID NO: 2473 - RNA, 21 nt, Artificial Sequence
  Description of Artificial Sequence: Synthetic oligonucleotide
  modified_base (20)..(21): a, c, g, u, unknown or other
ggggauggaugcccugguunn

SEQ ID NO: 2474 - RNA, 21 nt, Artificial Sequence
  Description of Artificial Sequence: Synthetic oligonucleotide
  modified_base (20)..(21): a, c, g, u, unknown or other
gggauggaugcccugguugnn

SEQ ID NO: 2475 - RNA, 21 nt, Artificial Sequence
  Description of Artificial Sequence: Synthetic oligonucleotide
  modified_base (20)..(21): a, c, g, u, unknown or other
ggauggaugcccugguugcnn

SEQ ID NO: 2476 - RNA, 21 nt, Artificial Sequence
  Description of Artificial Sequence: Synthetic oligonucleotide
  modified_base (20)..(21): a, c, g, u, unknown or other
gauggaugcccugguugcunn

SEQ ID NO: 2477 - RNA, 21 nt, Artificial Sequence
  Description of Artificial Sequence: Synthetic oligonucleotide
  modified_base (20)..(21): a, c, g, u, unknown or other
gcuaugguggugguggcagnn

SEQ ID NO: 2478 - RNA, 21 nt, Artificial Sequence
  Description of Artificial Sequence: Synthetic oligonucleotide
  modified_base (20)..(21): a, c, g, u, unknown or other
cuaugguggugguggcagcnn

SEQ ID NO: 2479 - RNA, 21 nt, Artificial Sequence
  Description of Artificial Sequence: Synthetic oligonucleotide
  modified_base (20)..(21): a, c, g, u, unknown or other
aagaggaggcggaagccaann

SEQ ID NO: 2480 - RNA, 21 nt, Artificial Sequence
  Description of Artificial Sequence: Synthetic oligonucleotide
  modified_base (20)..(21): a, c, g, u, unknown or other
agaggaggcggaagccaagnn

SEQ ID NO: 2481 - DNA, 21 bp, Artificial Sequence
  Description of Artificial Sequence: Synthetic oligonucleotide
  modified_base (20)..(21): a, c, g, u, unknown or other
gaggaggcggaagccaaggnn

SEQ ID NO: 2482 - DNA, 21 bp, Artificial Sequence
  Description of Artificial Sequence: Synthetic oligonucleotide
  modified_base (20)..(21): a, c, g, u, unknown or other
aggaggcggaagccaagggnn

SEQ ID NO: 2483 - DNA, 21 bp, Artificial Sequence
  Description of Artificial Sequence: Synthetic oligonucleotide
  modified_base (20)..(21): a, c, g, u, unknown or other
ggaggcggaagccaaggggnn

SEQ ID NO: 2484 - DNA, 21 bp, Artificial Sequence
  Description of Artificial Sequence: Synthetic oligonucleotide
  modified_base (20)..(21): a, c, g, u, unknown or other
uaugguggugguggcagccnn

SEQ ID NO: 2485 - RNA, 21 nt, Artificial Sequence
  Description of Artificial Sequence: Synthetic oligonucleotide
  modified_base (20)..(21): a, c, g, u, unknown or other
gaggcggaagccaaggggann

SEQ ID NO: 2486 - RNA, 21 nt, Artificial Sequence
  Description of Artificial Sequence: Synthetic oligonucleotide
  modified_base (20)..(21): a, c, g, u, unknown or other
aggcggaagccaaggggaann

SEQ ID NO: 2487 - DNA, 21 bp, Artificial Sequence
  Description of Artificial Sequence: Synthetic oligonucleotide
  modified_base (20)..(21): a, c, g, u, unknown or other
ggcggaagccaaggggaaunn

SEQ ID NO: 2488 - RNA, 21 nt, Artificial Sequence
  Description of Artificial Sequence: Synthetic oligonucleotide
  modified_base (20)..(21): a, c, g, u, unknown or other
gcggaagccaaggggaaugnn

SEQ ID NO: 2489 - RNA, 21 nt, Artificial Sequence
  Description of Artificial Sequence: Synthetic oligonucleotide
  modified_base (20)..(21): a, c, g, u, unknown or other
augguggugguggcagccgnn

SEQ ID NO: 2490 - RNA, 21 nt, Artificial Sequence
  Description of Artificial Sequence: Synthetic oligonucleotide
  modified_base (20)..(21): a, c, g, u, unknown or other
ugguggugguggcagccgcnn

SEQ ID NO: 2491 - RNA, 21 nt, Artificial Sequence
  Description of Artificial Sequence: Synthetic oligonucleotide
  modified_base (20)..(21): a, c, g, u, unknown or other
agugaggccaguggccgggnn

SEQ ID NO: 2492 - RNA, 21 nt, Artificial Sequence
  Description of Artificial Sequence: Synthetic oligonucleotide
  modified_base (20)..(21): a, c, g, u, unknown or other
gugaggccaguggccgggunn

SEQ ID NO: 2493 - RNA, 21 nt, Artificial Sequence
  Description of Artificial Sequence: Synthetic oligonucleotide
  modified_base (20)..(21): a, c, g, u, unknown or other
ugaggccaguggccgggucnn

SEQ ID NO: 2494 - RNA, 21 nt, Artificial Sequence
  Description of Artificial Sequence: Synthetic oligonucleotide
  modified_base (20)..(21): a, c, g, u, unknown or other
gaggccaguggccgggucunn

SEQ ID NO: 2495 - RNA, 21 nt, Artificial Sequence
  Description of Artificial Sequence: Synthetic oligonucleotide
  modified_base (20)..(21): a, c, g, u, unknown or other
aggccaguggccgggucugnn

SEQ ID NO: 2496 - RNA, 21 nt, Artificial Sequence
  Description of Artificial Sequence: Synthetic oligonucleotide
  modified_base (20)..(21): a, c, g, u, unknown or other
ggccaguggccgggucugcnn

SEQ ID NO: 2497 - RNA, 21 nt, Artificial Sequence
  Description of Artificial Sequence: Synthetic oligonucleotide
  modified_base (20)..(21): a, c, g, u, unknown or other
gccaguggccgggucugcunn

SEQ ID NO: 2498 - RNA, 21 nt, Artificial Sequence
  Description of Artificial Sequence: Synthetic oligonucleotide
  modified_base (20)..(21): a, c, g, u, unknown or other
ccaguggccgggucugcugnn

SEQ ID NO: 2499 - RNA, 21 nt, Artificial Sequence
  Description of Artificial Sequence: Synthetic oligonucleotide
  modified_base (20)..(21): a, c, g, u, unknown or other
caguggccgggucugcugann

SEQ ID NO: 2500 - RNA, 21 nt, Artificial Sequence
  Description of Artificial Sequence: Synthetic oligonucleotide
  modified_base (20)..(21): a, c, g, u, unknown or other
aguggccgggucugcugagnn

SEQ ID NO: 2501 - RNA, 21 nt, Artificial Sequence
  Description of Artificial Sequence: Synthetic oligonucleotide
  modified_base (20)..(21): a, c, g, u, unknown or other
guggccgggucugcugagunn

SEQ ID NO: 2502 - RNA, 21 nt, Artificial Sequence
  Description of Artificial Sequence: Synthetic oligonucleotide
  modified_base (20)..(21): a, c, g, u, unknown or other
uggccgggucugcugagucnn

SEQ ID NO: 2503 - RNA, 21 nt, Artificial Sequence
  Description of Artificial Sequence: Synthetic oligonucleotide
  modified_base (20)..(21): a, c, g, u, unknown or other
ggccgggucugcugaguccnn

SEQ ID NO: 2504 - RNA, 21 nt, Artificial Sequence
  Description of Artificial Sequence: Synthetic oligonucleotide
  modified_base (20)..(21): a, c, g, u, unknown or other
gccgggucugcugaguccgnn

SEQ ID NO: 2505 - RNA, 21 nt, Artificial Sequence
  Description of Artificial Sequence: Synthetic oligonucleotide
  modified_base (20)..(21): a, c, g, u, unknown or other
ccgggucugcugaguccgcnn

SEQ ID NO: 2506 - RNA, 21 nt, Artificial Sequence
  Description of Artificial Sequence: Synthetic oligonucleotide
  modified_base (20)..(21): a, c, g, u, unknown or other
cgggucugcugaguccgcann

SEQ ID NO: 2507 - RNA, 21 nt, Artificial Sequence
  Description of Artificial Sequence: Synthetic oligonucleotide
  modified_base (20)..(21): a, c, g, u, unknown or other
gggucugcugaguccgcagnn

SEQ ID NO: 2508 - RNA, 21 nt, Artificial Sequence
  Description of Artificial Sequence: Synthetic oligonucleotide
  modified_base (20)..(21): a, c, g, u, unknown or other
gugcaggcccaguugucacnn

SEQ ID NO: 2509 - RNA, 21 nt, Artificial Sequence
  Description of Artificial Sequence: Synthetic oligonucleotide
  modified_base (20)..(21): a, c, g, u, unknown or other
ugcaggcccaguugucaccnn

SEQ ID NO: 2510 - RNA, 21 nt, Artificial Sequence
  Description of Artificial Sequence: Synthetic oligonucleotide
  modified_base (20)..(21): a, c, g, u, unknown or other
gcaggcccaguugucacccnn

SEQ ID NO: 2511 - RNA, 21 nt, Artificial Sequence
  Description of Artificial Sequence: Synthetic oligonucleotide
  modified_base (20)..(21): a, c, g, u, unknown or other
caggcccaguugucaccccnn

SEQ ID NO: 2512 - RNA, 21 nt, Artificial Sequence
  Description of Artificial Sequence: Synthetic oligonucleotide
  modified_base (20)..(21): a, c, g, u, unknown or other
aggcccaguugucaccccunn

SEQ ID NO: 2513 - RNA, 21 nt, Artificial Sequence
  Description of Artificial Sequence: Synthetic oligonucleotide
  modified_base (20)..(21): a, c, g, u, unknown or other
ggcccaguugucaccccucnn

SEQ ID NO: 2514 - RNA, 21 nt, Artificial Sequence
  Description of Artificial Sequence: Synthetic oligonucleotide
  modified_base (20)..(21): a, c, g, u, unknown or other
gcccaguugucaccccuccnn

SEQ ID NO: 2515 - RNA, 21 nt, Artificial Sequence
  Description of Artificial Sequence: Synthetic oligonucleotide
  modified_base (20)..(21): a, c, g, u, unknown or other
cccaguugucaccccuccann

SEQ ID NO: 2516 - RNA, 21 nt, Artificial Sequence
  Description of Artificial Sequence: Synthetic oligonucleotide
  modified_base (20)..(21): a, c, g, u, unknown or other
ccaguugucaccccuccagnn

SEQ ID NO: 2517 - RNA, 21 nt, Artificial Sequence
  Description of Artificial Sequence: Synthetic oligonucleotide
  modified_base (20)..(21): a, c, g, u, unknown or other
caguugucaccccuccagann

SEQ ID NO: 2518 - RNA, 21 nt, Artificial Sequence
  Description of Artificial Sequence: Synthetic oligonucleotide
  modified_base (20)..(21): a, c, g, u, unknown or other
aguugucaccccuccagaann

SEQ ID NO: 2519 - RNA, 21 nt, Artificial Sequence
  Description of Artificial Sequence: Synthetic oligonucleotide
  modified_base (20)..(21): a, c, g, u, unknown or other
guugucaccccuccagaacnn

SEQ ID NO: 2520 - RNA, 21 nt, Artificial Sequence
  Description of Artificial Sequence: Synthetic oligonucleotide
  modified_base (20)..(21): a, c, g, u, unknown or other
uugucaccccuccagaacann

SEQ ID NO: 2521 - RNA, 21 nt, Artificial Sequence
  Description of Artificial Sequence: Synthetic oligonucleotide
  modified_base (20)..(21): a, c, g, u, unknown or other
ugucaccccuccagaacaunn

SEQ ID NO: 2522 - RNA, 21 nt, Artificial Sequence
  Description of Artificial Sequence: Synthetic oligonucleotide
  modified_base (20)..(21): a, c, g, u, unknown or other
gucaccccuccagaacaucnn

SEQ ID NO: 2523 - RNA, 21 nt, Artificial Sequence
  Description of Artificial Sequence: Synthetic oligonucleotide
  modified_base (20)..(21): a, c, g, u, unknown or other
ucaccccuccagaacaucunn

SEQ ID NO: 2524 - RNA, 21 nt, Artificial Sequence
  Description of Artificial Sequence: Synthetic oligonucleotide
  modified_base (20)..(21): a, c, g, u, unknown or other
caccccuccagaacaucucnn

SEQ ID NO: 2525 - RNA, 21 nt, Artificial Sequence
  Description of Artificial Sequence: Synthetic oligonucleotide
  modified_base (20)..(21): a, c, g, u, unknown or other
accccuccagaacaucuccnn

SEQ ID NO: 2526 - RNA, 21 nt, Artificial Sequence
  Description of Artificial Sequence: Synthetic oligonucleotide
  modified_base (20)..(21): a, c, g, u, unknown or other
ccccuccagaacaucucccnn

SEQ ID NO: 2527 - RNA, 21 nt, Artificial Sequence
  Description of Artificial Sequence: Synthetic oligonucleotide
  modified_base (20)..(21): a, c, g, u, unknown or other
cccuccagaacaucuccccnn

SEQ ID NO: 2528 - RNA, 21 nt, Artificial Sequence
  Description of Artificial Sequence: Synthetic oligonucleotide
  modified_base (20)..(21): a, c, g, u, unknown or other
ccuccagaacaucuccccann

SEQ ID NO: 2529 - RNA, 21 nt, Artificial Sequence
  Description of Artificial Sequence: Synthetic oligonucleotide
  modified_base (20)..(21): a, c, g, u, unknown or other
cuccagaacaucuccccaunn

SEQ ID NO: 2530 - RNA, 21 nt, Artificial Sequence
  Description of Artificial Sequence: Synthetic oligonucleotide
  modified_base (20)..(21): a, c, g, u, unknown or other
uccagaacaucuccccaugnn

SEQ ID NO: 2531 - RNA, 21 nt, Artificial Sequence
  Description of Artificial Sequence: Synthetic oligonucleotide
  modified_base (20)..(21): a, c, g, u, unknown or other
ccagaacaucuccccauggnn

SEQ ID NO: 2532 - RNA, 21 nt, Artificial Sequence
  Description of Artificial Sequence: Synthetic oligonucleotide
  modified_base (20)..(21): a, c, g, u, unknown or other
cagaacaucuccccauggann

SEQ ID NO: 2533 - RNA, 21 nt, Artificial Sequence
  Description of Artificial Sequence: Synthetic oligonucleotide
  modified_base (20)..(21): a, c, g, u, unknown or other
agaacaucuccccauggaunn

SEQ ID NO: 2534 - RNA, 21 nt, Artificial Sequence
  Description of Artificial Sequence: Synthetic oligonucleotide
  modified_base (20)..(21): a, c, g, u, unknown or other
gaacaucuccccauggauunn

SEQ ID NO: 2535 - RNA, 21 nt, Artificial Sequence
  Description of Artificial Sequence: Synthetic oligonucleotide
  modified_base (20)..(21): a, c, g, u, unknown or other
aacaucuccccauggauucnn

SEQ ID NO: 2536 - RNA, 21 nt, Artificial Sequence
  Description of Artificial Sequence: Synthetic oligonucleotide
  modified_base (20)..(21): a, c, g, u, unknown or other
acaucuccccauggauucunn

SEQ ID NO: 2537 - RNA, 21 nt, Artificial Sequence
  Description of Artificial Sequence: Synthetic oligonucleotide
  modified_base (20)..(21): a, c, g, u, unknown or other
caucuccccauggauucugnn

SEQ ID NO: 2538 - RNA, 21 nt, Artificial Sequence
  Description of Artificial Sequence: Synthetic oligonucleotide
  modified_base (20)..(21): a, c, g, u, unknown or other
aucuccccauggauucuggnn

SEQ ID NO: 2539 - RNA, 21 nt, Artificial Sequence
  Description of Artificial Sequence: Synthetic oligonucleotide
  modified_base (20)..(21): a, c, g, u, unknown or other
ucuccccauggauucuggcnn

SEQ ID NO: 2540 - RNA, 21 nt, Artificial Sequence
  Description of Artificial Sequence: Synthetic oligonucleotide
  modified_base (20)..(21): a, c, g, u, unknown or other
cuccccauggauucuggcgnn

SEQ ID NO: 2541 - RNA, 21 nt, Artificial Sequence
  Description of Artificial Sequence: Synthetic oligonucleotide
  modified_base (20)..(21): a, c, g, u, unknown or other
uccccauggauucuggcggnn

SEQ ID NO: 2542 - RNA, 21 nt, Artificial Sequence
  Description of Artificial Sequence: Synthetic oligonucleotide
  modified_base (20)..(21): a, c, g, u, unknown or other
ccccauggauucuggcggunn

SEQ ID NO: 2543 - RNA, 21 nt, Artificial Sequence
  Description of Artificial Sequence: Synthetic oligonucleotide
  modified_base (20)..(21): a, c, g, u, unknown or other
cccauggauucuggcgguann

SEQ ID NO: 2544 - RNA, 21 nt, Artificial Sequence
  Description of Artificial Sequence: Synthetic oligonucleotide
  modified_base (20)..(21): a, c, g, u, unknown or other
ccauggauucuggcgguaunn

SEQ ID NO: 2545 - RNA, 21 nt, Artificial Sequence
  Description of Artificial Sequence: Synthetic oligonucleotide
  modified_base (20)..(21): a, c, g, u, unknown or other
cauggauucuggcgguauunn

SEQ ID NO: 2546 - RNA, 21 nt, Artificial Sequence
  Description of Artificial Sequence: Synthetic oligonucleotide
  modified_base (20)..(21): a, c, g, u, unknown or other
auggauucuggcgguauugnn

SEQ ID NO: 2547 - RNA, 21 nt, Artificial Sequence
  Description of Artificial Sequence: Synthetic oligonucleotide
  modified_base (20)..(21): a, c, g, u, unknown or other
uggauucuggcgguauugann

SEQ ID NO: 2548 - RNA, 21 nt, Artificial Sequence
  Description of Artificial Sequence: Synthetic oligonucleotide
  modified_base (20)..(21): a, c, g, u, unknown or other
ggauucuggcgguauugacnn

SEQ ID NO: 2549 - RNA, 21 nt, Artificial Sequence
  Description of Artificial Sequence: Synthetic oligonucleotide
  modified_base (20)..(21): a, c, g, u, unknown or other
gauucuggcgguauugacunn

SEQ ID NO: 2550 - RNA, 21 nt, Artificial Sequence
  Description of Artificial Sequence: Synthetic oligonucleotide
  modified_base (20)..(21): a, c, g, u, unknown or other
auucuggcgguauugacucnn

SEQ ID NO: 2551 - RNA, 21 nt, Artificial Sequence
  Description of Artificial Sequence: Synthetic oligonucleotide
  modified_base (20)..(21): a, c, g, u, unknown or other
uucuggcgguauugacucunn

SEQ ID NO: 2552 - RNA, 21 nt, Artificial Sequence
  Description of Artificial Sequence: Synthetic oligonucleotide
  modified_base (20)..(21): a, c, g, u, unknown or other
ucuggcgguauugacucuunn

SEQ ID NO: 2553 - RNA, 21 nt, Artificial Sequence
  Description of Artificial Sequence: Synthetic oligonucleotide
  modified_base (20)..(21): a, c, g, u, unknown or other
cuggcgguauugacucuucnn

SEQ ID NO: 2554 - RNA, 21 nt, Artificial Sequence
  Description of Artificial Sequence: Synthetic oligonucleotide
  modified_base (20)..(21): a, c, g, u, unknown or other
uggcgguauugacucuucann

SEQ ID NO: 2555 - RNA, 21 nt, Artificial Sequence
  Description of Artificial Sequence: Synthetic oligonucleotide
  modified_base (20)..(21): a, c, g, u, unknown or other
ggcgguauugacucuucagnn

SEQ ID NO: 2556 - RNA, 21 nt, Artificial Sequence
  Description of Artificial Sequence: Synthetic oligonucleotide
  modified_base (20)..(21): a, c, g, u, unknown or other
gcgguauugacucuucagann

SEQ ID NO: 2557 - RNA, 21 nt, Artificial Sequence
  Description of Artificial Sequence: Synthetic oligonucleotide
  modified_base (20)..(21): a, c, g, u, unknown or other
cgguauugacucuucagaunn

SEQ ID NO: 2558 - RNA, 21 nt, Artificial Sequence
  Description of Artificial Sequence: Synthetic oligonucleotide
  modified_base (20)..(21): a, c, g, u, unknown or other
gguauugacucuucagauunn

SEQ ID NO: 2559 - RNA, 21 nt, Artificial Sequence
  Description of Artificial Sequence: Synthetic oligonucleotide
  modified_base (20)..(21): a, c, g, u, unknown or other
guauugacucuucagauucnn

SEQ ID NO: 2560 - RNA, 21 nt, Artificial Sequence
  Description of Artificial Sequence: Synthetic oligonucleotide
  modified_base (20)..(21): a, c, g, u, unknown or other
uauugacucuucagauucann

SEQ ID NO: 2561 - RNA, 21 nt, Artificial Sequence
  Description of Artificial Sequence: Synthetic oligonucleotide
  modified_base (20)..(21): a, c, g, u, unknown or other
auugacucuucagauucagnn

SEQ ID NO: 2562 - RNA, 21 nt, Artificial Sequence
  Description of Artificial Sequence: Synthetic oligonucleotide
  modified_base (20)..(21): a, c, g, u, unknown or other
uugacucuucagauucagann

SEQ ID NO: 2563 - RNA, 21 nt, Artificial Sequence
  Description of Artificial Sequence: Synthetic oligonucleotide
  modified_base (20)..(21): a, c, g, u, unknown or other
ugacucuucagauucagagnn

SEQ ID NO: 2564 - RNA, 21 nt, Artificial Sequence
  Description of Artificial Sequence: Synthetic oligonucleotide
  modified_base (20)..(21): a, c, g, u, unknown or other
gacucuucagauucagagunn

SEQ ID NO: 2565 - RNA, 21 nt, Artificial Sequence
  Description of Artificial Sequence: Synthetic oligonucleotide
  modified_base (20)..(21): a, c, g, u, unknown or other
acucuucagauucagagucnn

SEQ ID NO: 2566 - RNA, 21 nt, Artificial Sequence
  Description of Artificial Sequence: Synthetic oligonucleotide
  modified_base (20)..(21): a, c, g, u, unknown or other
cucuucagauucagagucunn

SEQ ID NO: 2567 - RNA, 21 nt, Artificial Sequence
  Description of Artificial Sequence: Synthetic oligonucleotide
  modified_base (20)..(21): a, c, g, u, unknown or other
ucuucagauucagagucugnn

SEQ ID NO: 2568 - RNA, 21 nt, Artificial Sequence
  Description of Artificial Sequence: Synthetic oligonucleotide
  modified_base (20)..(21): a, c, g, u, unknown or other
cuucagauucagagucugann

SEQ ID NO: 2569 - RNA, 21 nt, Artificial Sequence
  Description of Artificial Sequence: Synthetic oligonucleotide
  modified_base (20)..(21): a, c, g, u, unknown or other
uucagauucagagucugaunn

SEQ ID NO: 2570 - RNA, 21 nt, Artificial Sequence
  Description of Artificial Sequence: Synthetic oligonucleotide
  modified_base (20)..(21): a, c, g, u, unknown or other
ucagauucagagucugauann

SEQ ID NO: 2571 - RNA, 21 nt, Artificial Sequence
  Description of Artificial Sequence: Synthetic oligonucleotide
  modified_base (20)..(21): a, c, g, u, unknown or other
cagauucagagucugauaunn

SEQ ID NO: 2572 - RNA, 21 nt, Artificial Sequence
  Description of Artificial Sequence: Synthetic oligonucleotide
  modified_base (20)..(21): a, c, g, u, unknown or other
agauucagagucugauaucnn

SEQ ID NO: 2573 - RNA, 21 nt, Artificial Sequence
  Description of Artificial Sequence: Synthetic oligonucleotide
  modified_base (20)..(21): a, c, g, u, unknown or other
gauucagagucugauauccnn

SEQ ID NO: 2574 - RNA, 21 nt, Artificial Sequence
  Description of Artificial Sequence: Synthetic oligonucleotide
  modified_base (20)..(21): a, c, g, u, unknown or other
auucagagucugauauccunn

SEQ ID NO: 2575 - RNA, 21 nt, Artificial Sequence
  Description of Artificial Sequence: Synthetic oligonucleotide
  modified_base (20)..(21): a, c, g, u, unknown or other
uucagagucugauauccugnn

SEQ ID NO: 2576 - RNA, 21 nt, Artificial Sequence
  Description of Artificial Sequence: Synthetic oligonucleotide
  modified_base (20)..(21): a, c, g, u, unknown or other
ucagagucugauauccugunn

SEQ ID NO: 2577 - RNA, 21 nt, Artificial Sequence
  Description of Artificial Sequence: Synthetic oligonucleotide
  modified_base (20)..(21): a, c, g, u, unknown or other
cagagucugauauccuguunn

SEQ ID NO: 2578 - RNA, 21 nt, Artificial Sequence
  Description of Artificial Sequence: Synthetic oligonucleotide
  modified_base (20)..(21): a, c, g, u, unknown or other
agagucugauauccuguugnn

SEQ ID NO: 2579 - RNA, 21 nt, Artificial Sequence
  Description of Artificial Sequence: Synthetic oligonucleotide
  modified_base (20)..(21): a, c, g, u, unknown or other
gagucugauauccuguuggnn

SEQ ID NO: 2580 - RNA, 21 nt, Artificial Sequence
  Description of Artificial Sequence: Synthetic oligonucleotide
  modified_base (20)..(21): a, c, g, u, unknown or other
agucugauauccuguugggnn

SEQ ID NO: 2581 - RNA, 21 nt, Artificial Sequence
  Description of Artificial Sequence: Synthetic oligonucleotide
  modified_base (20)..(21): a, c, g, u, unknown or other
gucugauauccuguugggcnn

SEQ ID NO: 2582 - RNA, 21 nt, Artificial Sequence
  Description of Artificial Sequence: Synthetic oligonucleotide
  modified_base (20)..(21): a, c, g, u, unknown or other
ucugauauccuguugggcann

SEQ ID NO: 2583 - RNA, 21 nt, Artificial Sequence
  Description of Artificial Sequence: Synthetic oligonucleotide
  modified_base (20)..(21): a, c, g, u, unknown or other
cugauauccuguugggcaunn

SEQ ID NO: 2584 - RNA, 21 nt, Artificial Sequence
  Description of Artificial Sequence: Synthetic oligonucleotide
  modified_base (20)..(21): a, c, g, u, unknown or other
ugauauccuguugggcauunn

SEQ ID NO: 2585 - RNA, 21 nt, Artificial Sequence
  Description of Artificial Sequence: Synthetic oligonucleotide
  modified_base (20)..(21): a, c, g, u, unknown or other
gauauccuguugggcauucnn

SEQ ID NO: 2586 - RNA, 21 nt, Artificial Sequence
  Description of Artificial Sequence: Synthetic oligonucleotide
  modified_base (20)..(21): a, c, g, u, unknown or other
auauccuguugggcauucunn

SEQ ID NO: 2587 - RNA, 21 nt, Artificial Sequence
  Description of Artificial Sequence: Synthetic oligonucleotide
  modified_base (20)..(21): a, c, g, u, unknown or other
uauccuguugggcauucugnn

SEQ ID NO: 2588 - RNA, 21 nt, Artificial Sequence
  Description of Artificial Sequence: Synthetic oligonucleotide
  modified_base (20)..(21): a, c, g, u, unknown or other
auccuguugggcauucuggnn

SEQ ID NO: 2589 - RNA, 21 nt, Artificial Sequence
  Description of Artificial Sequence: Synthetic oligonucleotide
  modified_base (20)..(21): a, c, g, u, unknown or other
uccuguugggcauucuggann

SEQ ID NO: 2590 - RNA, 21 nt, Artificial Sequence
  Description of Artificial Sequence: Synthetic oligonucleotide
  modified_base (20)..(21): a, c, g, u, unknown or other
ccuguugggcauucuggacnn

SEQ ID NO: 2591 - RNA, 21 nt, Artificial Sequence
  Description of Artificial Sequence: Synthetic oligonucleotide
  modified_base (20)..(21): a, c, g, u, unknown or other
cuguugggcauucuggacann

SEQ ID NO: 2592 - RNA, 21 nt, Artificial Sequence
  Description of Artificial Sequence: Synthetic oligonucleotide
  modified_base (20)..(21): a, c, g, u, unknown or other
uguugggcauucuggacaann

SEQ ID NO: 2593 - RNA, 21 nt, Artificial Sequence
  Description of Artificial Sequence: Synthetic oligonucleotide
  modified_base (20)..(21): a, c, g, u, unknown or other
guugggcauucuggacaacnn

SEQ ID NO: 2594 - RNA, 21 nt, Artificial Sequence
  Description of Artificial Sequence: Synthetic oligonucleotide
  modified_base (20)..(21): a, c, g, u, unknown or other
uugggcauucuggacaacunn

SEQ ID NO: 2595 - RNA, 21 nt, Artificial Sequence
  Description of Artificial Sequence: Synthetic oligonucleotide
  modified_base (20)..(21): a, c, g, u, unknown or other
ugggcauucuggacaacuunn

SEQ ID NO: 2596 - RNA, 21 nt, Artificial Sequence
  Description of Artificial Sequence: Synthetic oligonucleotide
  modified_base (20)..(21): a, c, g, u, unknown or other
gggcauucuggacaacuugnn

SEQ ID NO: 2597 - RNA, 21 nt, Artificial Sequence
  Description of Artificial Sequence: Synthetic oligonucleotide
  modified_base (20)..(21): a, c, g, u, unknown or other
ggcauucuggacaacuuggnn

SEQ ID NO: 2598 - RNA, 21 nt, Artificial Sequence
  Description of Artificial Sequence: Synthetic oligonucleotide
  modified_base (20)..(21): a, c, g, u, unknown or other
gcauucuggacaacuuggann

SEQ ID NO: 2599 - RNA, 21 nt, Artificial Sequence
  Description of Artificial Sequence: Synthetic oligonucleotide
  modified_base (20)..(21): a, c, g, u, unknown or other
cauucuggacaacuuggacnn

SEQ ID NO: 2600 - RNA, 21 nt, Artificial Sequence
  Description of Artificial Sequence: Synthetic oligonucleotide
  modified_base (20)..(21): a, c, g, u, unknown or other
auucuggacaacuuggaccnn

SEQ ID NO: 2601 - RNA, 21 nt, Artificial Sequence
  Description of Artificial Sequence: Synthetic oligonucleotide
  modified_base (20)..(21): a, c, g, u, unknown or other
uucuggacaacuuggacccnn

SEQ ID NO: 2602 - RNA, 21 nt, Artificial Sequence
  Description of Artificial Sequence: Synthetic oligonucleotide
  modified_base (20)..(21): a, c, g, u, unknown or other
ucuggacaacuuggacccann

SEQ ID NO: 2603 - RNA, 21 nt, Artificial Sequence
  Description of Artificial Sequence: Synthetic oligonucleotide
  modified_base (20)..(21): a, c, g, u, unknown or other
cuggacaacuuggacccagnn

SEQ ID NO: 2604 - RNA, 21 nt, Artificial Sequence
  Description of Artificial Sequence: Synthetic oligonucleotide
  modified_base (20)..(21): a, c, g, u, unknown or other
uggacaacuuggacccagunn

SEQ ID NO: 2605 - RNA, 21 nt, Artificial Sequence
  Description of Artificial Sequence: Synthetic oligonucleotide
  modified_base (20)..(21): a, c, g, u, unknown or other
ggacaacuuggacccagucnn

SEQ ID NO: 2606 - RNA, 21 nt, Artificial Sequence
  Description of Artificial Sequence: Synthetic oligonucleotide
  modified_base (20)..(21): a, c, g, u, unknown or other
gacaacuuggacccagucann

SEQ ID NO: 2607 - RNA, 21 nt, Artificial Sequence
  Description of Artificial Sequence: Synthetic oligonucleotide
  modified_base (20)..(21): a, c, g, u, unknown or other
acaacuuggacccagucaunn

SEQ ID NO: 2608 - RNA, 21 nt, Artificial Sequence
  Description of Artificial Sequence: Synthetic oligonucleotide
  modified_base (20)..(21): a, c, g, u, unknown or other
caacuuggacccagucaugnn

SEQ ID NO: 2609 - RNA, 21 nt, Artificial Sequence
  Description of Artificial Sequence: Synthetic oligonucleotide
  modified_base (20)..(21): a, c, g, u, unknown or other
aacuuggacccagucaugunn

SEQ ID NO: 2610 - RNA, 21 nt, Artificial Sequence
  Description of Artificial Sequence: Synthetic oligonucleotide
  modified_base (20)..(21): a, c, g, u, unknown or other
acuuggacccagucauguunn

SEQ ID NO: 2611 - RNA, 21 nt, Artificial Sequence
  Description of Artificial Sequence: Synthetic oligonucleotide
  modified_base (20)..(21): a, c, g, u, unknown or other
cuuggacccagucauguucnn

SEQ ID NO: 2612 - RNA, 21 nt, Artificial Sequence
  Description of Artificial Sequence: Synthetic oligonucleotide
  modified_base (20)..(21): a, c, g, u, unknown or other
uuggacccagucauguucunn

SEQ ID NO: 2613 - RNA, 21 nt, Artificial Sequence
  Description of Artificial Sequence: Synthetic oligonucleotide
  modified_base (20)..(21): a, c, g, u, unknown or other
uggacccagucauguucuunn

SEQ ID NO: 2614 - RNA, 21 nt, Artificial Sequence
  Description of Artificial Sequence: Synthetic oligonucleotide
  modified_base (20)..(21): a, c, g, u, unknown or other
ggacccagucauguucuucnn

SEQ ID NO: 2615 - RNA, 21 nt, Artificial Sequence
  Description of Artificial Sequence: Synthetic oligonucleotide
  modified_base (20)..(21): a, c, g, u, unknown or other
gacccagucauguucuucann

SEQ ID NO: 2616 - RNA, 21 nt, Artificial Sequence
  Description of Artificial Sequence: Synthetic oligonucleotide
  modified_base (20)..(21): a, c, g, u, unknown or other
acccagucauguucuucaann

SEQ ID NO: 2617 - RNA, 21 nt, Artificial Sequence
  Description of Artificial Sequence: Synthetic oligonucleotide
  modified_base (20)..(21): a, c, g, u, unknown or other
cccagucauguucuucaaann

SEQ ID NO: 2618 - RNA, 21 nt, Artificial Sequence
  Description of Artificial Sequence: Synthetic oligonucleotide
  modified_base (20)..(21): a, c, g, u, unknown or other
ccagucauguucuucaaaunn

SEQ ID NO: 2619 - RNA, 21 nt, Artificial Sequence
  Description of Artificial Sequence: Synthetic oligonucleotide
  modified_base (20)..(21): a, c, g, u, unknown or other
cagucauguucuucaaaugnn

SEQ ID NO: 2620 - RNA, 21 nt, Artificial Sequence
  Description of Artificial Sequence: Synthetic oligonucleotide
  modified_base (20)..(21): a, c, g, u, unknown or other
agucauguucuucaaaugcnn

SEQ ID NO: 2621 - RNA, 21 nt, Artificial Sequence
  Description of Artificial Sequence: Synthetic oligonucleotide
  modified_base (20)..(21): a, c, g, u, unknown or other
gucauguucuucaaaugccnn

SEQ ID NO: 2622 - RNA, 21 nt, Artificial Sequence
  Description of Artificial Sequence: Synthetic oligonucleotide
  modified_base (20)..(21): a, c, g, u, unknown or other
ucauguucuucaaaugcccnn

SEQ ID NO: 2623 - RNA, 21 nt, Artificial Sequence
  Description of Artificial Sequence: Synthetic oligonucleotide
  modified_base (20)..(21): a, c, g, u, unknown or other
cauguucuucaaaugcccunn

SEQ ID NO: 2624 - RNA, 21 nt, Artificial Sequence
  Description of Artificial Sequence: Synthetic oligonucleotide
  modified_base (20)..(21): a, c, g, u, unknown or other
auguucuucaaaugcccuunn

SEQ ID NO: 2625 - RNA, 21 nt, Artificial Sequence
  Description of Artificial Sequence: Synthetic oligonucleotide
  modified_base (20)..(21): a, c, g, u, unknown or other
uguucuucaaaugcccuucnn

SEQ ID NO: 2626 - RNA, 21 nt, Artificial Sequence
  Description of Artificial Sequence: Synthetic oligonucleotide
  modified_base (20)..(21): a, c, g, u, unknown or other
guucuucaaaugcccuuccnn

SEQ ID NO: 2627 - RNA, 21 nt, Artificial Sequence
  Description of Artificial Sequence: Synthetic oligonucleotide
  modified_base (20)..(21): a, c, g, u, unknown or other
uucuucaaaugcccuucccnn

SEQ ID NO: 2628 - RNA, 21 nt, Artificial Sequence
  Description of Artificial Sequence: Synthetic oligonucleotide
  modified_base (20)..(21): a, c, g, u, unknown or other
ucuucaaaugcccuuccccnn

SEQ ID NO: 2629 - RNA, 21 nt, Artificial Sequence
  Description of Artificial Sequence: Synthetic oligonucleotide
  modified_base (20)..(21): a, c, g, u, unknown or other
cuucaaaugcccuuccccann

SEQ ID NO: 2630 - RNA, 21 nt, Artificial Sequence
  Description of Artificial Sequence: Synthetic oligonucleotide
  modified_base (20)..(21): a, c, g, u, unknown or other
uucaaaugcccuuccccagnn

SEQ ID NO: 2631 - RNA, 21 nt, Artificial Sequence
  Description of Artificial Sequence: Synthetic oligonucleotide
  modified_base (20)..(21): a, c, g, u, unknown or other
ucaaaugcccuuccccagann

SEQ ID NO: 2632 - RNA, 21 nt, Artificial Sequence
  Description of Artificial Sequence: Synthetic oligonucleotide
  modified_base (20)..(21): a, c, g, u, unknown or other
caaaugcccuuccccagagnn

SEQ ID NO: 2633 - RNA, 21 nt, Artificial Sequence
  Description of Artificial Sequence: Synthetic oligonucleotide
  modified_base (20)..(21): a, c, g, u, unknown or other
cugccagccuggaggagcunn

SEQ ID NO: 2634 - RNA, 21 nt, Artificial Sequence
  Description of Artificial Sequence: Synthetic oligonucleotide
  modified_base (20)..(21): a, c, g, u, unknown or other
ugccagccuggaggagcucnn

SEQ ID NO: 2635 - RNA, 21 nt, Artificial Sequence
  Description of Artificial Sequence: Synthetic oligonucleotide
  modified_base (20)..(21): a, c, g, u, unknown or other
gccagccuggaggagcuccnn

SEQ ID NO: 2636 - RNA, 21 nt, Artificial Sequence
  Description of Artificial Sequence: Synthetic oligonucleotide
  modified_base (20)..(21): a, c, g, u, unknown or other
ccagccuggaggagcucccnn

SEQ ID NO: 2637 - RNA, 21 nt, Artificial Sequence
  Description of Artificial Sequence: Synthetic oligonucleotide
  modified_base (20)..(21): a, c, g, u, unknown or other
cagccuggaggagcucccann

SEQ ID NO: 2638 - RNA, 21 nt, Artificial Sequence
  Description of Artificial Sequence: Synthetic oligonucleotide
  modified_base (20)..(21): a, c, g, u, unknown or other
agccuggaggagcucccagnn

SEQ ID NO: 2639 - RNA, 21 nt, Artificial Sequence
  Description of Artificial Sequence: Synthetic oligonucleotide
  modified_base (20)..(21): a, c, g, u, unknown or other
gccuggaggagcucccagann

SEQ ID NO: 2640 - RNA, 21 nt, Artificial Sequence
  Description of Artificial Sequence: Synthetic oligonucleotide
  modified_base (20)..(21): a, c, g, u, unknown or other
ccuggaggagcucccagagnn

SEQ ID NO: 2641 - RNA, 21 nt, Artificial Sequence
  Description of Artificial Sequence: Synthetic oligonucleotide
  modified_base (20)..(21): a, c, g, u, unknown or other
cuggaggagcucccagaggnn

SEQ ID NO: 2642 - RNA, 21 nt, Artificial Sequence
  Description of Artificial Sequence: Synthetic oligonucleotide
  modified_base (20)..(21): a, c, g, u, unknown or other
uggaggagcucccagaggunn

SEQ ID NO: 2643 - RNA, 21 nt, Artificial Sequence
  Description of Artificial Sequence: Synthetic oligonucleotide
  modified_base (20)..(21): a, c, g, u, unknown or other
ggaggagcucccagaggucnn

SEQ ID NO: 2644 - RNA, 21 nt, Artificial Sequence
  Description of Artificial Sequence: Synthetic oligonucleotide
  modified_base (20)..(21): a, c, g, u, unknown or other
gaggagcucccagaggucunn

SEQ ID NO: 2645 - RNA, 21 nt, Artificial Sequence
  Description of Artificial Sequence: Synthetic oligonucleotide
  modified_base (20)..(21): a, c, g, u, unknown or other
aggagcucccagaggucuann

SEQ ID NO: 2646 - RNA, 21 nt, Artificial Sequence
  Description of Artificial Sequence: Synthetic oligonucleotide
  modified_base (20)..(21): a, c, g, u, unknown or other
ggagcucccagaggucuacnn

SEQ ID NO: 2647 - RNA, 21 nt, Artificial Sequence
  Description of Artificial Sequence: Synthetic oligonucleotide
  modified_base (20)..(21): a, c, g, u, unknown or other
gagcucccagaggucuaccnn

SEQ ID NO: 2648 - RNA, 21 nt, Artificial Sequence
  Description of Artificial Sequence: Synthetic oligonucleotide
  modified_base (20)..(21): a, c, g, u, unknown or other
agcucccagaggucuacccnn

SEQ ID NO: 2649 - RNA, 21 nt, Artificial Sequence
  Description of Artificial Sequence: Synthetic oligonucleotide
  modified_base (20)..(21): a, c, g, u, unknown or other
gcucccagaggucuacccann

SEQ ID NO: 2650 - RNA, 21 nt, Artificial Sequence
  Description of Artificial Sequence: Synthetic oligonucleotide
  modified_base (20)..(21): a, c, g, u, unknown or other
cucccagaggucuacccagnn

SEQ ID NO: 2651 - RNA, 21 nt, Artificial Sequence
  Description of Artificial Sequence: Synthetic oligonucleotide
  modified_base (20)..(21): a, c, g, u, unknown or other
ucccagaggucuacccagann

SEQ ID NO: 2652 - RNA, 21 nt, Artificial Sequence
  Description of Artificial Sequence: Synthetic oligonucleotide
  modified_base (20)..(21): a, c, g, u, unknown or other
cccagaggucuacccagaann

SEQ ID NO: 2653 - RNA, 21 nt, Artificial Sequence
  Description of Artificial Sequence: Synthetic oligonucleotide
  modified_base (20)..(21): a, c, g, u, unknown or other
ccagaggucuacccagaagnn

SEQ ID NO: 2654 - RNA, 21 nt, Artificial Sequence
  Description of Artificial Sequence: Synthetic oligonucleotide
  modified_base (20)..(21): a, c, g, u, unknown or other
cagaggucuacccagaaggnn

SEQ ID NO: 2655 - RNA, 21 nt, Artificial Sequence
  Description of Artificial Sequence: Synthetic oligonucleotide
  modified_base (20)..(21): a, c, g, u, unknown or other
agaggucuacccagaaggann

SEQ ID NO: 2656 - RNA, 21 nt, Artificial Sequence
  Description of Artificial Sequence: Synthetic oligonucleotide
  modified_base (20)..(21): a, c, g, u, unknown or other
gaggucuacccagaaggacnn

SEQ ID NO: 2657 - RNA, 21 nt, Artificial Sequence
  Description of Artificial Sequence: Synthetic oligonucleotide
  modified_base (20)..(21): a, c, g, u, unknown or other
aggucuacccagaaggaccnn

SEQ ID NO: 2658 - RNA, 21 nt, Artificial Sequence
  Description of Artificial Sequence: Synthetic oligonucleotide
  modified_base (20)..(21): a, c, g, u, unknown or other
ggucuacccagaaggacccnn

SEQ ID NO: 2659 - RNA, 21 nt, Artificial Sequence
  Description of Artificial Sequence: Synthetic oligonucleotide
  modified_base (20)..(21): a, c, g, u, unknown or other
gucuacccagaaggacccann

SEQ ID NO: 2660 - RNA, 21 nt, Artificial Sequence
  Description of Artificial Sequence: Synthetic oligonucleotide
  modified_base (20)..(21): a, c, g, u, unknown or other
ucuacccagaaggacccagnn

SEQ ID NO: 2661 - RNA, 21 nt, Artificial Sequence
  Description of Artificial Sequence: Synthetic oligonucleotide
  modified_base (20)..(21): a, c, g, u, unknown or other
cuacccagaaggacccagunn

SEQ ID NO: 2662 - RNA, 21 nt, Artificial Sequence
  Description of Artificial Sequence: Synthetic oligonucleotide
  modified_base (20)..(21): a, c, g, u, unknown or other
uacccagaaggacccaguunn

SEQ ID NO: 2663 - RNA, 21 nt, Artificial Sequence
  Description of Artificial Sequence: Synthetic oligonucleotide
  modified_base (20)..(21): a, c, g, u, unknown or other
acccagaaggacccaguucnn

SEQ ID NO: 2664 - RNA, 21 nt, Artificial Sequence
  Description of Artificial Sequence: Synthetic oligonucleotide
  modified_base (20)..(21): a, c, g, u, unknown or other
cccagaaggacccaguuccnn

SEQ ID NO: 2665 - RNA, 21 nt, Artificial Sequence
  Description of Artificial Sequence: Synthetic oligonucleotide
  modified_base (20)..(21): a, c, g, u, unknown or other
ccagaaggacccaguuccunn

SEQ ID NO: 2666 - RNA, 21 nt, Artificial Sequence
  Description of Artificial Sequence: Synthetic oligonucleotide
  modified_base (20)..(21): a, c, g, u, unknown or other
cagaaggacccaguuccuunn

SEQ ID NO: 2667 - RNA, 21 nt, Artificial Sequence
  Description of Artificial Sequence: Synthetic oligonucleotide
  modified_base (20)..(21): a, c, g, u, unknown or other
agaaggacccaguuccuuann

SEQ ID NO: 2668 - RNA, 21 nt, Artificial Sequence
  Description of Artificial Sequence: Synthetic oligonucleotide
  modified_base (20)..(21): a, c, g, u, unknown or other
gaaggacccaguuccuuacnn

SEQ ID NO: 2669 - RNA, 21 nt, Artificial Sequence
  Description of Artificial Sequence: Synthetic oligonucleotide
  modified_base (20)..(21): a, c, g, u, unknown or other
aaggacccaguuccuuaccnn

SEQ ID NO: 2670 - RNA, 21 nt, Artificial Sequence
  Description of Artificial Sequence: Synthetic oligonucleotide
  modified_base (20)..(21): a, c, g, u, unknown or other
aggacccaguuccuuaccann

SEQ ID NO: 2671 - RNA, 21 nt, Artificial Sequence
  Description of Artificial Sequence: Synthetic oligonucleotide
  modified_base (20)..(21): a, c, g, u, unknown or other
ggacccaguuccuuaccagnn

SEQ ID NO: 2672 - RNA, 21 nt, Artificial Sequence
  Description of Artificial Sequence: Synthetic oligonucleotide
  modified_base (20)..(21): a, c, g, u, unknown or other
gacccaguuccuuaccagcnn

SEQ ID NO: 2673 - RNA, 21 nt, Artificial Sequence
  Description of Artificial Sequence: Synthetic oligonucleotide
  modified_base (20)..(21): a, c, g, u, unknown or other
acccaguuccuuaccagccnn

SEQ ID NO: 2674 - RNA, 21 nt, Artificial Sequence
  Description of Artificial Sequence: Synthetic oligonucleotide
  modified_base (20)..(21): a, c, g, u, unknown or other
cccaguuccuuaccagccunn

SEQ ID NO: 2675 - RNA, 21 nt, Artificial Sequence
  Description of Artificial Sequence: Synthetic oligonucleotide
  modified_base (20)..(21): a, c, g, u, unknown or other
ccaguuccuuaccagccucnn

SEQ ID NO: 2676 - RNA, 21 nt, Artificial Sequence
  Description of Artificial Sequence: Synthetic oligonucleotide
  modified_base (20)..(21): a, c, g, u, unknown or other
caguuccuuaccagccuccnn

SEQ ID NO: 2677 - RNA, 21 nt, Artificial Sequence
  Description of Artificial Sequence: Synthetic oligonucleotide
  modified_base (20)..(21): a, c, g, u, unknown or other
aguuccuuaccagccucccnn

SEQ ID NO: 2678 - RNA, 21 nt, Artificial Sequence
  Description of Artificial Sequence: Synthetic oligonucleotide
  modified_base (20)..(21): a, c, g, u, unknown or other
guuccuuaccagccucccunn

SEQ ID NO: 2679 - RNA, 21 nt, Artificial Sequence
  Description of Artificial Sequence: Synthetic oligonucleotide
  modified_base (20)..(21): a, c, g, u, unknown or other
uuccuuaccagccucccuunn

SEQ ID NO: 2680 - RNA, 21 nt, Artificial Sequence
  Description of Artificial Sequence: Synthetic oligonucleotide
  modified_base (20)..(21): a, c, g, u, unknown or other
uccuuaccagccucccuuunn

SEQ ID NO: 2681 - RNA, 21 nt, Artificial Sequence
  Description of Artificial Sequence: Synthetic oligonucleotide
  modified_base (20)..(21): a, c, g, u, unknown or other
ccuuaccagccucccuuucnn

SEQ ID NO: 2682 - RNA, 21 nt, Artificial Sequence
  Description of Artificial Sequence: Synthetic oligonucleotide
  modified_base (20)..(21): a, c, g, u, unknown or other
cuuaccagccucccuuucunn

SEQ ID NO: 2683 - RNA, 21 nt, Artificial Sequence
  Description of Artificial Sequence: Synthetic oligonucleotide
  modified_base (20)..(21): a, c, g, u, unknown or other
uuaccagccucccuuucucnn

SEQ ID NO: 2684 - RNA, 21 nt, Artificial Sequence
  Description of Artificial Sequence: Synthetic oligonucleotide
  modified_base (20)..(21): a, c, g, u, unknown or other
uaccagccucccuuucucunn

SEQ ID NO: 2685 - RNA, 21 nt, Artificial Sequence
  Description of Artificial Sequence: Synthetic oligonucleotide
  modified_base (20)..(21): a, c, g, u, unknown or other
accagccucccuuucucugnn

SEQ ID NO: 2686 - RNA, 21 nt, Artificial Sequence
  Description of Artificial Sequence: Synthetic oligonucleotide
  modified_base (20)..(21): a, c, g, u, unknown or other
ccagccucccuuucucugunn

SEQ ID NO: 2687 - RNA, 21 nt, Artificial Sequence
  Description of Artificial Sequence: Synthetic oligonucleotide
  modified_base (20)..(21): a, c, g, u, unknown or other
cagccucccuuucucugucnn

SEQ ID NO: 2688 - RNA, 21 nt, Artificial Sequence
  Description of Artificial Sequence: Synthetic oligonucleotide
  modified_base (20)..(21): a, c, g, u, unknown or other
agccucccuuucucugucann

SEQ ID NO: 2689 - RNA, 21 nt, Artificial Sequence
  Description of Artificial Sequence: Synthetic oligonucleotide
  modified_base (20)..(21): a, c, g, u, unknown or other
gccucccuuucucugucagnn

SEQ ID NO: 2690 - RNA, 21 nt, Artificial Sequence
  Description of Artificial Sequence: Synthetic oligonucleotide
  modified_base (20)..(21): a, c, g, u, unknown or other
ccucccuuucucugucagunn

SEQ ID NO: 2691 - RNA, 21 nt, Artificial Sequence
  Description of Artificial Sequence: Synthetic oligonucleotide
  modified_base (20)..(21): a, c, g, u, unknown or other
cucccuuucucugucagugnn

SEQ ID NO: 2692 - RNA, 21 nt, Artificial Sequence
  Description of Artificial Sequence: Synthetic oligonucleotide
  modified_base (20)..(21): a, c, g, u, unknown or other
ucccuuucucugucaguggnn

SEQ ID NO: 2693 - RNA, 21 nt, Artificial Sequence
  Description of Artificial Sequence: Synthetic oligonucleotide
  modified_base (20)..(21): a, c, g, u, unknown or other
cccuuucucugucagugggnn

SEQ ID NO: 2694 - RNA, 21 nt, Artificial Sequence
  Description of Artificial Sequence: Synthetic oligonucleotide
  modified_base (20)..(21): a, c, g, u, unknown or other
ccuuucucugucaguggggnn

SEQ ID NO: 2695 - RNA, 21 nt, Artificial Sequence
  Description of Artificial Sequence: Synthetic oligonucleotide
  modified_base (20)..(21): a, c, g, u, unknown or other
cuuucucugucaguggggann

SEQ ID NO: 2696 - RNA, 21 nt, Artificial Sequence
  Description of Artificial Sequence: Synthetic oligonucleotide
  modified_base (20)..(21): a, c, g, u, unknown or other
uuucucugucaguggggacnn

SEQ ID NO: 2697 - RNA, 21 nt, Artificial Sequence
  Description of Artificial Sequence: Synthetic oligonucleotide
  modified_base (20)..(21): a, c, g, u, unknown or other
uucucugucaguggggacgnn

SEQ ID NO: 2698 - RNA, 21 nt, Artificial Sequence
  Description of Artificial Sequence: Synthetic oligonucleotide
  modified_base (20)..(21): a, c, g, u, unknown or other
ucucugucaguggggacgunn

SEQ ID NO: 2699 - RNA, 21 nt, Artificial Sequence
  Description of Artificial Sequence: Synthetic oligonucleotide
  modified_base (20)..(21): a, c, g, u, unknown or other
cucugucaguggggacgucnn

SEQ ID NO: 2700 - RNA, 21 nt, Artificial Sequence
  Description of Artificial Sequence: Synthetic oligonucleotide
  modified_base (20)..(21): a, c, g, u, unknown or other
ucugucaguggggacgucann

SEQ ID NO: 2701 - RNA, 21 nt, Artificial Sequence
  Description of Artificial Sequence: Synthetic oligonucleotide
  modified_base (20)..(21): a, c, g, u, unknown or other
cugucaguggggacgucaunn

SEQ ID NO: 2702 - RNA, 21 nt, Artificial Sequence
  Description of Artificial Sequence: Synthetic oligonucleotide
  modified_base (20)..(21): a, c, g, u, unknown or other
ugucaguggggacgucaucnn

SEQ ID NO: 2703 - RNA, 21 nt, Artificial Sequence
  Description of Artificial Sequence: Synthetic oligonucleotide
  modified_base (20)..(21): a, c, g, u, unknown or other
gucaguggggacgucaucann

SEQ ID NO: 2704 - RNA, 21 nt, Artificial Sequence
  Description of Artificial Sequence: Synthetic oligonucleotide
  modified_base (20)..(21): a, c, g, u, unknown or other
ucaguggggacgucaucagnn

SEQ ID NO: 2705 - RNA, 21 nt, Artificial Sequence
  Description of Artificial Sequence: Synthetic oligonucleotide
  modified_base (20)..(21): a, c, g, u, unknown or other
caguggggacgucaucagcnn

SEQ ID NO: 2706 - RNA, 21 nt, Artificial Sequence
  Description of Artificial Sequence: Synthetic oligonucleotide
  modified_base (20)..(21): a, c, g, u, unknown or other
aguggggacgucaucagccnn

SEQ ID NO: 2707 - RNA, 21 nt, Artificial Sequence
  Description of Artificial Sequence: Synthetic oligonucleotide
  modified_base (20)..(21): a, c, g, u, unknown or other
guggggacgucaucagccann

SEQ ID NO: 2708 - RNA, 21 nt, Artificial Sequence
  Description of Artificial Sequence: Synthetic oligonucleotide
  modified_base (20)..(21): a, c, g, u, unknown or other
uggggacgucaucagccaann

SEQ ID NO: 2709 - RNA, 21 nt, Artificial Sequence
  Description of Artificial Sequence: Synthetic oligonucleotide
  modified_base (20)..(21): a, c, g, u, unknown or other
ggggacgucaucagccaagnn

SEQ ID NO: 2710 - RNA, 21 nt, Artificial Sequence
  Description of Artificial Sequence: Synthetic oligonucleotide
  modified_base (20)..(21): a, c, g, u, unknown or other
gggacgucaucagccaagcnn

SEQ ID NO: 2711 - RNA, 21 nt, Artificial Sequence
  Description of Artificial Sequence: Synthetic oligonucleotide
  modified_base (20)..(21): a, c, g, u, unknown or other
ggacgucaucagccaagcunn

SEQ ID NO: 2712 - RNA, 21 nt, Artificial Sequence
  Description of Artificial Sequence: Synthetic oligonucleotide
  modified_base (20)..(21): a, c, g, u, unknown or other
gacgucaucagccaagcugnn

SEQ ID NO: 2713 - RNA, 21 nt, Artificial Sequence
  Description of Artificial Sequence: Synthetic oligonucleotide
  modified_base (20)..(21): a, c, g, u, unknown or other
acgucaucagccaagcuggnn

SEQ ID NO: 2714 - RNA, 21 nt, Artificial Sequence
  Description of Artificial Sequence: Synthetic oligonucleotide
  modified_base (20)..(21): a, c, g, u, unknown or other
cgucaucagccaagcuggann

SEQ ID NO: 2715 - RNA, 21 nt, Artificial Sequence
  Description of Artificial Sequence: Synthetic oligonucleotide
  modified_base (20)..(21): a, c, g, u, unknown or other
gucaucagccaagcuggaann

SEQ ID NO: 2716 - RNA, 21 nt, Artificial Sequence
  Description of Artificial Sequence: Synthetic oligonucleotide
  modified_base (20)..(21): a, c, g, u, unknown or other
ucaucagccaagcuggaagnn

SEQ ID NO: 2717 - RNA, 21 nt, Artificial Sequence
  Description of Artificial Sequence: Synthetic oligonucleotide
  modified_base (20)..(21): a, c, g, u, unknown or other
caucagccaagcuggaagcnn

SEQ ID NO: 2718 - RNA, 21 nt, Artificial Sequence
  Description of Artificial Sequence: Synthetic oligonucleotide
  modified_base (20)..(21): a, c, g, u, unknown or other
aucagccaagcuggaagccnn

SEQ ID NO: 2719 - RNA, 21 nt, Artificial Sequence
  Description of Artificial Sequence: Synthetic oligonucleotide
  modified_base (20)..(21): a, c, g, u, unknown or other
ucagccaagcuggaagccann

SEQ ID NO: 2720 - RNA, 21 nt, Artificial Sequence
  Description of Artificial Sequence: Synthetic oligonucleotide
  modified_base (20)..(21): a, c, g, u, unknown or other
cagccaagcuggaagccaunn

SEQ ID NO: 2721 - RNA, 21 nt, Artificial Sequence
  Description of Artificial Sequence: Synthetic oligonucleotide
  modified_base (20)..(21): a, c, g, u, unknown or other
agccaagcuggaagccauunn

SEQ ID NO: 2722 - RNA, 21 nt, Artificial Sequence
  Description of Artificial Sequence: Synthetic oligonucleotide
  modified_base (20)..(21): a, c, g, u, unknown or other
gccaagcuggaagccauuann

SEQ ID NO: 2723 - RNA, 21 nt, Artificial Sequence
  Description of Artificial Sequence: Synthetic oligonucleotide
  modified_base (20)..(21): a, c, g, u, unknown or other
ccaagcuggaagccauuaann

SEQ ID NO: 2724 - RNA, 21 nt, Artificial Sequence
  Description of Artificial Sequence: Synthetic oligonucleotide
  modified_base (20)..(21): a, c, g, u, unknown or other
caagcuggaagccauuaaunn

SEQ ID NO: 2725 - RNA, 21 nt, Artificial Sequence
  Description of Artificial Sequence: Synthetic oligonucleotide
  modified_base (20)..(21): a, c, g, u, unknown or other
aagcuggaagccauuaaugnn

SEQ ID NO: 2726 - RNA, 21 nt, Artificial Sequence
  Description of Artificial Sequence: Synthetic oligonucleotide
  modified_base (20)..(21): a, c, g, u, unknown or other
agcuggaagccauuaaugann

SEQ ID NO: 2727 - RNA, 21 nt, Artificial Sequence
  Description of Artificial Sequence: Synthetic oligonucleotide
  modified_base (20)..(21): a, c, g, u, unknown or other
gcuggaagccauuaaugaann

SEQ ID NO: 2728 - RNA, 21 nt, Artificial Sequence
  Description of Artificial Sequence: Synthetic oligonucleotide
  modified_base (20)..(21): a, c, g, u, unknown or other
cuggaagccauuaaugaacnn

SEQ ID NO: 2729 - RNA, 21 nt, Artificial Sequence
  Description of Artificial Sequence: Synthetic oligonucleotide
  modified_base (20)..(21): a, c, g, u, unknown or other
uggaagccauuaaugaacunn

SEQ ID NO: 2730 - RNA, 21 nt, Artificial Sequence
  Description of Artificial Sequence: Synthetic oligonucleotide
  modified_base (20)..(21): a, c, g, u, unknown or other
ggaagccauuaaugaacuann

SEQ ID NO: 2731 - RNA, 21 nt, Artificial Sequence
  Description of Artificial Sequence: Synthetic oligonucleotide
  modified_base (20)..(21): a, c, g, u, unknown or other
gaagccauuaaugaacuaann

SEQ ID NO: 2732 - RNA, 21 nt, Artificial Sequence
  Description of Artificial Sequence: Synthetic oligonucleotide
  modified_base (20)..(21): a, c, g, u, unknown or other
aagccauuaaugaacuaaunn

SEQ ID NO: 2733 - RNA, 21 nt, Artificial Sequence
  Description of Artificial Sequence: Synthetic oligonucleotide
  modified_base (20)..(21): a, c, g, u, unknown or other
agccauuaaugaacuaauunn

SEQ ID NO: 2734 - RNA, 21 nt, Artificial Sequence
  Description of Artificial Sequence: Synthetic oligonucleotide
  modified_base (20)..(21): a, c, g, u, unknown or other
gccauuaaugaacuaauucnn

SEQ ID NO: 2735 - RNA, 21 nt, Artificial Sequence
  Description of Artificial Sequence: Synthetic oligonucleotide
  modified_base (20)..(21): a, c, g, u, unknown or other
ccauuaaugaacuaauucgnn

SEQ ID NO: 2736 - RNA, 21 nt, Artificial Sequence
  Description of Artificial Sequence: Synthetic oligonucleotide
  modified_base (20)..(21): a, c, g, u, unknown or other
cauuaaugaacuaauucgunn

SEQ ID NO: 2737 - RNA, 21 nt, Artificial Sequence
  Description of Artificial Sequence: Synthetic oligonucleotide
  modified_base (20)..(21): a, c, g, u, unknown or other
auuaaugaacuaauucguunn

SEQ ID NO: 2738 - RNA, 21 nt, Artificial Sequence
  Description of Artificial Sequence: Synthetic oligonucleotide
  modified_base (20)..(21): a, c, g, u, unknown or other
uuaaugaacuaauucguuunn

SEQ ID NO: 2739 - RNA, 21 nt, Artificial Sequence
  Description of Artificial Sequence: Synthetic oligonucleotide
  modified_base (20)..(21): a, c, g, u, unknown or other
uaaugaacuaauucguuuunn

SEQ ID NO: 2740 - RNA, 21 nt, Artificial Sequence
  Description of Artificial Sequence: Synthetic oligonucleotide
  modified_base (20)..(21): a, c, g, u, unknown or other
aaugaacuaauucguuuugnn

SEQ ID NO: 2741 - RNA, 21 nt, Artificial Sequence
  Description of Artificial Sequence: Synthetic oligonucleotide
  modified_base (20)..(21): a, c, g, u, unknown or other
augaacuaauucguuuugann

SEQ ID NO: 2742 - RNA, 21 nt, Artificial Sequence
  Description of Artificial Sequence: Synthetic oligonucleotide
  modified_base (20)..(21): a, c, g, u, unknown or other
ugaacuaauucguuuugacnn

SEQ ID NO: 2743 - RNA, 21 nt, Artificial Sequence
  Description of Artificial Sequence: Synthetic oligonucleotide
  modified_base (20)..(21): a, c, g, u, unknown or other
gaacuaauucguuuugaccnn

SEQ ID NO: 2744 - RNA, 21 nt, Artificial Sequence
  Description of Artificial Sequence: Synthetic oligonucleotide
  modified_base (20)..(21): a, c, g, u, unknown or other
aacuaauucguuuugaccann

SEQ ID NO: 2745 - RNA, 21 nt, Artificial Sequence
  Description of Artificial Sequence: Synthetic oligonucleotide
  modified_base (20)..(21): a, c, g, u, unknown or other
acuaauucguuuugaccacnn

SEQ ID NO: 2746 - RNA, 21 nt, Artificial Sequence
  Description of Artificial Sequence: Synthetic oligonucleotide
  modified_base (20)..(21): a, c, g, u, unknown or other
cuaauucguuuugaccacann

SEQ ID NO: 2747 - RNA, 21 nt, Artificial Sequence
  Description of Artificial Sequence: Synthetic oligonucleotide
  modified_base (20)..(21): a, c, g, u, unknown or other
uaauucguuuugaccacaunn

SEQ ID NO: 2748 - RNA, 21 nt, Artificial Sequence
  Description of Artificial Sequence: Synthetic oligonucleotide
  modified_base (20)..(21): a, c, g, u, unknown or other
aauucguuuugaccacauann

SEQ ID NO: 2749 - RNA, 21 nt, Artificial Sequence
  Description of Artificial Sequence: Synthetic oligonucleotide
  modified_base (20)..(21): a, c, g, u, unknown or other
auucguuuugaccacauaunn

SEQ ID NO: 2750 - RNA, 21 nt, Artificial Sequence
  Description of Artificial Sequence: Synthetic oligonucleotide
  modified_base (20)..(21): a, c, g, u, unknown or other
uucguuuugaccacauauann

SEQ ID NO: 2751 - RNA, 21 nt, Artificial Sequence
  Description of Artificial Sequence: Synthetic oligonucleotide
  modified_base (20)..(21): a, c, g, u, unknown or other
ucguuuugaccacauauaunn

SEQ ID NO: 2752 - RNA, 21 nt, Artificial Sequence
  Description of Artificial Sequence: Synthetic oligonucleotide
  modified_base (20)..(21): a, c, g, u, unknown or other
cguuuugaccacauauauann

SEQ ID NO: 2753 - RNA, 21 nt, Artificial Sequence
  Description of Artificial Sequence: Synthetic oligonucleotide
  modified_base (20)..(21): a, c, g, u, unknown or other
guuuugaccacauauauacnn

SEQ ID NO: 2754 - RNA, 21 nt, Artificial Sequence
  Description of Artificial Sequence: Synthetic oligonucleotide
  modified_base (20)..(21): a, c, g, u, unknown or other
uuuugaccacauauauaccnn

SEQ ID NO: 2755 - RNA, 21 nt, Artificial Sequence
  Description of Artificial Sequence: Synthetic oligonucleotide
  modified_base (20)..(21): a, c, g, u, unknown or other
uuugaccacauauauaccann

SEQ ID NO: 2756 - RNA, 21 nt, Artificial Sequence
  Description of Artificial Sequence: Synthetic oligonucleotide
  modified_base (20)..(21): a, c, g, u, unknown or other
uugaccacauauauaccaann

SEQ ID NO: 2757 - RNA, 21 nt, Artificial Sequence
  Description of Artificial Sequence: Synthetic oligonucleotide
  modified_base (20)..(21): a, c, g, u, unknown or other
ugaccacauauauaccaagnn

SEQ ID NO: 2758 - RNA, 21 nt, Artificial Sequence
  Description of Artificial Sequence: Synthetic oligonucleotide
  modified_base (20)..(21): a, c, g, u, unknown or other
gaccacauauauaccaagcnn

SEQ ID NO: 2759 - RNA, 21 nt, Artificial Sequence
  Description of Artificial Sequence: Synthetic oligonucleotide
  modified_base (20)..(21): a, c, g, u, unknown or other
accacauauauaccaagccnn

SEQ ID NO: 2760 - RNA, 21 nt, Artificial Sequence
  Description of Artificial Sequence: Synthetic oligonucleotide
  modified_base (20)..(21): a, c, g, u, unknown or other
ccacauauauaccaagcccnn

SEQ ID NO: 2761 - RNA, 21 nt, Artificial Sequence
  Description of Artificial Sequence: Synthetic oligonucleotide
  modified_base (20)..(21): a, c, g, u, unknown or other
cacauauauaccaagccccnn

SEQ ID NO: 2762 - RNA, 21 nt, Artificial Sequence
  Description of Artificial Sequence: Synthetic oligonucleotide
  modified_base (20)..(21): a, c, g, u, unknown or other
acauauauaccaagccccunn

SEQ ID NO: 2763 - RNA, 21 nt, Artificial Sequence
  Description of Artificial Sequence: Synthetic oligonucleotide
  modified_base (20)..(21): a, c, g, u, unknown or other
gucuuagagauacccucugnn

SEQ ID NO: 2764 - RNA, 21 nt, Artificial Sequence
  Description of Artificial Sequence: Synthetic oligonucleotide
  modified_base (20)..(21): a, c, g, u, unknown or other
ucuuagagauacccucugann

SEQ ID NO: 2765 - RNA, 21 nt, Artificial Sequence
  Description of Artificial Sequence: Synthetic oligonucleotide
  modified_base (20)..(21): a, c, g, u, unknown or other
cuuagagauacccucugagnn

SEQ ID NO: 2766 - RNA, 21 nt, Artificial Sequence
  Description of Artificial Sequence: Synthetic oligonucleotide
  modified_base (20)..(21): a, c, g, u, unknown or other
uuagagauacccucugagann

SEQ ID NO: 2767 - RNA, 21 nt, Artificial Sequence
  Description of Artificial Sequence: Synthetic oligonucleotide
  modified_base (20)..(21): a, c, g, u, unknown or other
uagagauacccucugagacnn

SEQ ID NO: 2768 - RNA, 21 nt, Artificial Sequence
  Description of Artificial Sequence: Synthetic oligonucleotide
  modified_base (20)..(21): a, c, g, u, unknown or other
agagauacccucugagacann

SEQ ID NO: 2769 - RNA, 21 nt, Artificial Sequence
  Description of Artificial Sequence: Synthetic oligonucleotide
  modified_base (20)..(21): a, c, g, u, unknown or other
gagauacccucugagacagnn

SEQ ID NO: 2770 - RNA, 21 nt, Artificial Sequence
  Description of Artificial Sequence: Synthetic oligonucleotide
  modified_base (20)..(21): a, c, g, u, unknown or other
agauacccucugagacagann

SEQ ID NO: 2771 - RNA, 21 nt, Artificial Sequence
  Description of Artificial Sequence: Synthetic oligonucleotide
  modified_base (20)..(21): a, c, g, u, unknown or other
gauacccucugagacagagnn

SEQ ID NO: 2772 - RNA, 21 nt, Artificial Sequence
  Description of Artificial Sequence: Synthetic oligonucleotide
  modified_base (20)..(21): a, c, g, u, unknown or other
auacccucugagacagagann

SEQ ID NO: 2773 - RNA, 21 nt, Artificial Sequence
  Description of Artificial Sequence: Synthetic oligonucleotide
  modified_base (20)..(21): a, c, g, u, unknown or other
uacccucugagacagagagnn

SEQ ID NO: 2774 - RNA, 21 nt, Artificial Sequence
  Description of Artificial Sequence: Synthetic oligonucleotide
  modified_base (20)..(21): a, c, g, u, unknown or other
acccucugagacagagagcnn

SEQ ID NO: 2775 - RNA, 21 nt, Artificial Sequence
  Description of Artificial Sequence: Synthetic oligonucleotide
  modified_base (20)..(21): a, c, g, u, unknown or other
cccucugagacagagagccnn

SEQ ID NO: 2776 - RNA, 21 nt, Artificial Sequence
  Description of Artificial Sequence: Synthetic oligonucleotide
  modified_base (20)..(21): a, c, g, u, unknown or other
ccucugagacagagagccann

SEQ ID NO: 2777 - RNA, 21 nt, Artificial Sequence
  Description of Artificial Sequence: Synthetic oligonucleotide
  modified_base (20)..(21): a, c, g, u, unknown or other
cucugagacagagagccaann

SEQ ID NO: 2778 - RNA, 21 nt, Artificial Sequence
  Description of Artificial Sequence: Synthetic oligonucleotide
  modified_base (20)..(21): a, c, g, u, unknown or other
ucugagacagagagccaagnn

SEQ ID NO: 2779 - RNA, 21 nt, Artificial Sequence
  Description of Artificial Sequence: Synthetic oligonucleotide
  modified_base (20)..(21): a, c, g, u, unknown or other
cugagacagagagccaagcnn

SEQ ID NO: 2780 - RNA, 21 nt, Artificial Sequence
  Description of Artificial Sequence: Synthetic oligonucleotide
  modified_base (20)..(21): a, c, g, u, unknown or other
ugagacagagagccaagcunn

SEQ ID NO: 2781 - RNA, 21 nt, Artificial Sequence
  Description of Artificial Sequence: Synthetic oligonucleotide
  modified_base (20)..(21): a, c, g, u, unknown or other
gagacagagagccaagcuann

SEQ ID NO: 2782 - RNA, 21 nt, Artificial Sequence
  Description of Artificial Sequence: Synthetic oligonucleotide
  modified_base (20)..(21): a, c, g, u, unknown or other
agacagagagccaagcuaann

SEQ ID NO: 2783 - RNA, 21 nt, Artificial Sequence
  Description of Artificial Sequence: Synthetic oligonucleotide
  modified_base (20)..(21): a, c, g, u, unknown or other
gacagagagccaagcuaaunn

SEQ ID NO: 2784 - RNA, 21 nt, Artificial Sequence
  Description of Artificial Sequence: Synthetic oligonucleotide
  modified_base (20)..(21): a, c, g, u, unknown or other
acagagagccaagcuaaugnn

SEQ ID NO: 2785 - RNA, 21 nt, Artificial Sequence
  Description of Artificial Sequence: Synthetic oligonucleotide
  modified_base (20)..(21): a, c, g, u, unknown or other
cagagagccaagcuaaugunn

SEQ ID NO: 2786 - RNA, 21 nt, Artificial Sequence
  Description of Artificial Sequence: Synthetic oligonucleotide
  modified_base (20)..(21): a, c, g, u, unknown or other
agagagccaagcuaaugugnn

SEQ ID NO: 2787 - RNA, 21 nt, Artificial Sequence
  Description of Artificial Sequence: Synthetic oligonucleotide
  modified_base (20)..(21): a, c, g, u, unknown or other
gagagccaagcuaauguggnn

SEQ ID NO: 2788 - RNA, 21 nt, Artificial Sequence
  Description of Artificial Sequence: Synthetic oligonucleotide
  modified_base (20)..(21): a, c, g, u, unknown or other
agagccaagcuaauguggunn

SEQ ID NO: 2789 - RNA, 21 nt, Artificial Sequence
  Description of Artificial Sequence: Synthetic oligonucleotide
  modified_base (20)..(21): a, c, g, u, unknown or other
gagccaagcuaaugugguann

SEQ ID NO: 2790 - RNA, 21 nt, Artificial Sequence
  Description of Artificial Sequence: Synthetic oligonucleotide
  modified_base (20)..(21): a, c, g, u, unknown or other
agccaagcuaaugugguagnn

SEQ ID NO: 2791 - RNA, 21 nt, Artificial Sequence
  Description of Artificial Sequence: Synthetic oligonucleotide
  modified_base (20)..(21): a, c, g, u, unknown or other
gccaagcuaaugugguagunn

SEQ ID NO: 2792 - RNA, 21 nt, Artificial Sequence
  Description of Artificial Sequence: Synthetic oligonucleotide
  modified_base (20)..(21): a, c, g, u, unknown or other
ccaagcuaaugugguagugnn

SEQ ID NO: 2793 - RNA, 21 nt, Artificial Sequence
  Description of Artificial Sequence: Synthetic oligonucleotide
  modified_base (20)..(21): a, c, g, u, unknown or other
caagcuaaugugguagugann

SEQ ID NO: 2794 - RNA, 21 nt, Artificial Sequence
  Description of Artificial Sequence: Synthetic oligonucleotide
  modified_base (20)..(21): a, c, g, u, unknown or other
aagcuaaugugguagugaann

SEQ ID NO: 2795 - RNA, 21 nt, Artificial Sequence
  Description of Artificial Sequence: Synthetic oligonucleotide
  modified_base (20)..(21): a, c, g, u, unknown or other
agcuaaugugguagugaaann

SEQ ID NO: 2796 - RNA, 21 nt, Artificial Sequence
  Description of Artificial Sequence: Synthetic oligonucleotide
  modified_base (20)..(21): a, c, g, u, unknown or other
gcuaaugugguagugaaaann

SEQ ID NO: 2797 - RNA, 21 nt, Artificial Sequence
  Description of Artificial Sequence: Synthetic oligonucleotide
  modified_base (20)..(21): a, c, g, u, unknown or other
cuaaugugguagugaaaaunn

SEQ ID NO: 2798 - RNA, 21 nt, Artificial Sequence
  Description of Artificial Sequence: Synthetic oligonucleotide
  modified_base (20)..(21): a, c, g, u, unknown or other
uaaugugguagugaaaaucnn

SEQ ID NO: 2799 - RNA, 21 nt, Artificial Sequence
  Description of Artificial Sequence: Synthetic oligonucleotide
  modified_base (20)..(21): a, c, g, u, unknown or other
aaugugguagugaaaaucgnn

SEQ ID NO: 2800 - RNA, 21 nt, Artificial Sequence
  Description of Artificial Sequence: Synthetic oligonucleotide
  modified_base (20)..(21): a, c, g, u, unknown or other
augugguagugaaaaucgann

SEQ ID NO: 2801 - RNA, 21 nt, Artificial Sequence
  Description of Artificial Sequence: Synthetic oligonucleotide
  modified_base (20)..(21): a, c, g, u, unknown or other
ugugguagugaaaaucgagnn

SEQ ID NO: 2802 - RNA, 21 nt, Artificial Sequence
  Description of Artificial Sequence: Synthetic oligonucleotide
  modified_base (20)..(21): a, c, g, u, unknown or other
gugguagugaaaaucgaggnn

SEQ ID NO: 2803 - RNA, 21 nt, Artificial Sequence
  Description of Artificial Sequence: Synthetic oligonucleotide
  modified_base (20)..(21): a, c, g, u, unknown or other
ugguagugaaaaucgaggann

SEQ ID NO: 2804 - RNA, 21 nt, Artificial Sequence
  Description of Artificial Sequence: Synthetic oligonucleotide
  modified_base (20)..(21): a, c, g, u, unknown or other
gguagugaaaaucgaggaann

SEQ ID NO: 2805 - RNA, 21 nt, Artificial Sequence
  Description of Artificial Sequence: Synthetic oligonucleotide
  modified_base (20)..(21): a, c, g, u, unknown or other
guagugaaaaucgaggaagnn

SEQ ID NO: 2806 - RNA, 21 nt, Artificial Sequence
  Description of Artificial Sequence: Synthetic oligonucleotide
  modified_base (20)..(21): a, c, g, u, unknown or other
uagugaaaaucgaggaagcnn

SEQ ID NO: 2807 - RNA, 21 nt, Artificial Sequence
  Description of Artificial Sequence: Synthetic oligonucleotide
  modified_base (20)..(21): a, c, g, u, unknown or other
agugaaaaucgaggaagcann

SEQ ID NO: 2808 - RNA, 21 nt, Artificial Sequence
  Description of Artificial Sequence: Synthetic oligonucleotide
  modified_base (20)..(21): a, c, g, u, unknown or other
gugaaaaucgaggaagcacnn

SEQ ID NO: 2809 - RNA, 21 nt, Artificial Sequence
  Description of Artificial Sequence: Synthetic oligonucleotide
  modified_base (20)..(21): a, c, g, u, unknown or other
ugaaaaucgaggaagcaccnn

SEQ ID NO: 2810 - RNA, 21 nt, Artificial Sequence
  Description of Artificial Sequence: Synthetic oligonucleotide
  modified_base (20)..(21): a, c, g, u, unknown or other
gaaaaucgaggaagcaccunn

SEQ ID NO: 2811 - RNA, 21 nt, Artificial Sequence
  Description of Artificial Sequence: Synthetic oligonucleotide
  modified_base (20)..(21): a, c, g, u, unknown or other
aaaaucgaggaagcaccucnn

SEQ ID NO: 2812 - RNA, 21 nt, Artificial Sequence
  Description of Artificial Sequence: Synthetic oligonucleotide
  modified_base (20)..(21): a, c, g, u, unknown or other
aaaucgaggaagcaccucunn

SEQ ID NO: 2813 - RNA, 21 nt, Artificial Sequence
  Description of Artificial Sequence: Synthetic oligonucleotide
  modified_base (20)..(21): a, c, g, u, unknown or other
aaucgaggaagcaccucucnn

SEQ ID NO: 2814 - RNA, 21 nt, Artificial Sequence
  Description of Artificial Sequence: Synthetic oligonucleotide
  modified_base (20)..(21): a, c, g, u, unknown or other
aucgaggaagcaccucucann

SEQ ID NO: 2815 - RNA, 21 nt, Artificial Sequence
  Description of Artificial Sequence: Synthetic oligonucleotide
  modified_base (20)..(21): a, c, g, u, unknown or other
ucgaggaagcaccucucagnn

SEQ ID NO: 2816 - RNA, 21 nt, Artificial Sequence
  Description of Artificial Sequence: Synthetic oligonucleotide
  modified_base (20)..(21): a, c, g, u, unknown or other
cgaggaagcaccucucagcnn

SEQ ID NO: 2817 - RNA, 21 nt, Artificial Sequence
  Description of Artificial Sequence: Synthetic oligonucleotide
  modified_base (20)..(21): a, c, g, u, unknown or other
gaggaagcaccucucagccnn

SEQ ID NO: 2818 - RNA, 21 nt, Artificial Sequence
  Description of Artificial Sequence: Synthetic oligonucleotide
  modified_base (20)..(21): a, c, g, u, unknown or other
aggaagcaccucucagcccnn

SEQ ID NO: 2819 - RNA, 21 nt, Artificial Sequence
  Description of Artificial Sequence: Synthetic oligonucleotide
  modified_base (20)..(21): a, c, g, u, unknown or other
ggaagcaccucucagccccnn

SEQ ID NO: 2820 - RNA, 21 nt, Artificial Sequence
  Description of Artificial Sequence: Synthetic oligonucleotide
  modified_base (20)..(21): a, c, g, u, unknown or other
gaagcaccucucagccccunn

SEQ ID NO: 2821 - RNA, 21 nt, Artificial Sequence
  Description of Artificial Sequence: Synthetic oligonucleotide
  modified_base (20)..(21): a, c, g, u, unknown or other
aagcaccucucagccccucnn

SEQ ID NO: 2822 - RNA, 21 nt, Artificial Sequence
  Description of Artificial Sequence: Synthetic oligonucleotide
  modified_base (20)..(21): a, c, g, u, unknown or other
agcaccucucagccccucann

SEQ ID NO: 2823 - RNA, 21 nt, Artificial Sequence
  Description of Artificial Sequence: Synthetic oligonucleotide
  modified_base (20)..(21): a, c, g, u, unknown or other
gcaccucucagccccucagnn

SEQ ID NO: 2824 - RNA, 21 nt, Artificial Sequence
  Description of Artificial Sequence: Synthetic oligonucleotide
  modified_base (20)..(21): a, c, g, u, unknown or other
caccucucagccccucagann

SEQ ID NO: 2825 - RNA, 21 nt, Artificial Sequence
  Description of Artificial Sequence: Synthetic oligonucleotide
  modified_base (20)..(21): a, c, g, u, unknown or other
accucucagccccucagagnn

SEQ ID NO: 2826 - RNA, 21 nt, Artificial Sequence
  Description of Artificial Sequence: Synthetic oligonucleotide
  modified_base (20)..(21): a, c, g, u, unknown or other
ccucucagccccucagagann

SEQ ID NO: 2827 - RNA, 21 nt, Artificial Sequence
  Description of Artificial Sequence: Synthetic oligonucleotide
  modified_base (20)..(21): a, c, g, u, unknown or other
cucucagccccucagagaann

SEQ ID NO: 2828 - RNA, 21 nt, Artificial Sequence
  Description of Artificial Sequence: Synthetic oligonucleotide
  modified_base (20)..(21): a, c, g, u, unknown or other
ucucagccccucagagaaunn

SEQ ID NO: 2829 - RNA, 21 nt, Artificial Sequence
  Description of Artificial Sequence: Synthetic oligonucleotide
  modified_base (20)..(21): a, c, g, u, unknown or other
cucagccccucagagaaugnn

SEQ ID NO: 2830 - RNA, 21 nt, Artificial Sequence
  Description of Artificial Sequence: Synthetic oligonucleotide
  modified_base (20)..(21): a, c, g, u, unknown or other
ucagccccucagagaaugann

SEQ ID NO: 2831 - RNA, 21 nt, Artificial Sequence
  Description of Artificial Sequence: Synthetic oligonucleotide
  modified_base (20)..(21): a, c, g, u, unknown or other
cagccccucagagaaugaunn

SEQ ID NO: 2832 - RNA, 21 nt, Artificial Sequence
  Description of Artificial Sequence: Synthetic oligonucleotide
  modified_base (20)..(21): a, c, g, u, unknown or other
agccccucagagaaugaucnn

SEQ ID NO: 2833 - RNA, 21 nt, Artificial Sequence
  Description of Artificial Sequence: Synthetic oligonucleotide
  modified_base (20)..(21): a, c, g, u, unknown or other
gccccucagagaaugaucann

SEQ ID NO: 2834 - RNA, 21 nt, Artificial Sequence
  Description of Artificial Sequence: Synthetic oligonucleotide
  modified_base (20)..(21): a, c, g, u, unknown or other
ccccucagagaaugaucacnn

SEQ ID NO: 2835 - RNA, 21 nt, Artificial Sequence
  Description of Artificial Sequence: Synthetic oligonucleotide
  modified_base (20)..(21): a, c, g, u, unknown or other
cccucagagaaugaucaccnn

SEQ ID NO: 2836 - RNA, 21 nt, Artificial Sequence
  Description of Artificial Sequence: Synthetic oligonucleotide
  modified_base (20)..(21): a, c, g, u, unknown or other
ccucagagaaugaucacccnn

SEQ ID NO: 2837 - RNA, 21 nt, Artificial Sequence
  Description of Artificial Sequence: Synthetic oligonucleotide
  modified_base (20)..(21): a, c, g, u, unknown or other
cucagagaaugaucacccunn

SEQ ID NO: 2838 - RNA, 21 nt, Artificial Sequence
  Description of Artificial Sequence: Synthetic oligonucleotide
  modified_base (20)..(21): a, c, g, u, unknown or other
ucagagaaugaucacccugnn

SEQ ID NO: 2839 - RNA, 21 nt, Artificial Sequence
  Description of Artificial Sequence: Synthetic oligonucleotide
  modified_base (20)..(21): a, c, g, u, unknown or other
cagagaaugaucacccugann

SEQ ID NO: 2840 - RNA, 21 nt, Artificial Sequence
  Description of Artificial Sequence: Synthetic oligonucleotide
  modified_base (20)..(21): a, c, g, u, unknown or other
agagaaugaucacccugaann

SEQ ID NO: 2841 - RNA, 21 nt, Artificial Sequence
  Description of Artificial Sequence: Synthetic oligonucleotide
  modified_base (20)..(21): a, c, g, u, unknown or other
gagaaugaucacccugaaunn

SEQ ID NO: 2842 - RNA, 21 nt, Artificial Sequence
  Description of Artificial Sequence: Synthetic oligonucleotide
  modified_base (20)..(21): a, c, g, u, unknown or other
agaaugaucacccugaauunn

SEQ ID NO: 2843 - RNA, 21 nt, Artificial Sequence
  Description of Artificial Sequence: Synthetic oligonucleotide
  modified_base (20)..(21): a, c, g, u, unknown or other
gaaugaucacccugaauucnn

SEQ ID NO: 2844 - RNA, 21 nt, Artificial Sequence
  Description of Artificial Sequence: Synthetic oligonucleotide
  modified_base (20)..(21): a, c, g, u, unknown or other
aaugaucacccugaauucann

SEQ ID NO: 2845 - RNA, 21 nt, Artificial Sequence
  Description of Artificial Sequence: Synthetic oligonucleotide
  modified_base (20)..(21): a, c, g, u, unknown or other
augaucacccugaauucaunn

SEQ ID NO: 2846 - RNA, 21 nt, Artificial Sequence
  Description of Artificial Sequence: Synthetic oligonucleotide
  modified_base (20)..(21): a, c, g, u, unknown or other
ugaucacccugaauucauunn

SEQ ID NO: 2847 - RNA, 21 nt, Artificial Sequence
  Description of Artificial Sequence: Synthetic oligonucleotide
  modified_base (20)..(21): a, c, g, u, unknown or other
gaucacccugaauucauugnn

SEQ ID NO: 2848 - RNA, 21 nt, Artificial Sequence
  Description of Artificial Sequence: Synthetic oligonucleotide
  modified_base (20)..(21): a, c, g, u, unknown or other
aucacccugaauucauugunn

SEQ ID NO: 2849 - RNA, 21 nt, Artificial Sequence
  Description of Artificial Sequence: Synthetic oligonucleotide
  modified_base (20)..(21): a, c, g, u, unknown or other
ucacccugaauucauugucnn

SEQ ID NO: 2850 - RNA, 21 nt, Artificial Sequence
  Description of Artificial Sequence: Synthetic oligonucleotide
  modified_base (20)..(21): a, c, g, u, unknown or other
cacccugaauucauugucunn

SEQ ID NO: 2851 - RNA, 21 nt, Artificial Sequence
  Description of Artificial Sequence: Synthetic oligonucleotide
  modified_base (20)..(21): a, c, g, u, unknown or other
acccugaauucauugucucnn

SEQ ID NO: 2852 - RNA, 21 nt, Artificial Sequence
  Description of Artificial Sequence: Synthetic oligonucleotide
  modified_base (20)..(21): a, c, g, u, unknown or other
cccugaauucauugucucann

SEQ ID NO: 2853 - RNA, 21 nt, Artificial Sequence
  Description of Artificial Sequence: Synthetic oligonucleotide
  modified_base (20)..(21): a, c, g, u, unknown or other
ccugaauucauugucucagnn

SEQ ID NO: 2854 - RNA, 21 nt, Artificial Sequence
  Description of Artificial Sequence: Synthetic oligonucleotide
  modified_base (20)..(21): a, c, g, u, unknown or other
cugaauucauugucucagunn

SEQ ID NO: 2855 - RNA, 21 nt, Artificial Sequence
  Description of Artificial Sequence: Synthetic oligonucleotide
  modified_base (20)..(21): a, c, g, u, unknown or other
ugaauucauugucucagugnn

SEQ ID NO: 2856 - RNA, 21 nt, Artificial Sequence
  Description of Artificial Sequence: Synthetic oligonucleotide
  modified_base (20)..(21): a, c, g, u, unknown or other
gaauucauugucucagugann

SEQ ID NO: 2857 - RNA, 21 nt, Artificial Sequence
  Description of Artificial Sequence: Synthetic oligonucleotide
  modified_base (20)..(21): a, c, g, u, unknown or other
aauucauugucucagugaann

SEQ ID NO: 2858 - RNA, 21 nt, Artificial Sequence
  Description of Artificial Sequence: Synthetic oligonucleotide
  modified_base (20)..(21): a, c, g, u, unknown or other
auucauugucucagugaagnn

SEQ ID NO: 2859 - RNA, 21 nt, Artificial Sequence
  Description of Artificial Sequence: Synthetic oligonucleotide
  modified_base (20)..(21): a, c, g, u, unknown or other
uucauugucucagugaaggnn

SEQ ID NO: 2860 - RNA, 21 nt, Artificial Sequence
  Description of Artificial Sequence: Synthetic oligonucleotide
  modified_base (20)..(21): a, c, g, u, unknown or other
ucauugucucagugaaggann

SEQ ID NO: 2861 - RNA, 21 nt, Artificial Sequence
  Description of Artificial Sequence: Synthetic oligonucleotide
  modified_base (20)..(21): a, c, g, u, unknown or other
cauugucucagugaaggaann

SEQ ID NO: 2862 - RNA, 21 nt, Artificial Sequence
  Description of Artificial Sequence: Synthetic oligonucleotide
  modified_base (20)..(21): a, c, g, u, unknown or other
auugucucagugaaggaagnn

SEQ ID NO: 2863 - RNA, 21 nt, Artificial Sequence
  Description of Artificial Sequence: Synthetic oligonucleotide
  modified_base (20)..(21): a, c, g, u, unknown or other
uugucucagugaaggaagann

SEQ ID NO: 2864 - RNA, 21 nt, Artificial Sequence
  Description of Artificial Sequence: Synthetic oligonucleotide
  modified_base (20)..(21): a, c, g, u, unknown or other
ugucucagugaaggaagaann

SEQ ID NO: 2865 - RNA, 21 nt, Artificial Sequence
  Description of Artificial Sequence: Synthetic oligonucleotide
  modified_base (20)..(21): a, c, g, u, unknown or other
gucucagugaaggaagaacnn

SEQ ID NO: 2866 - RNA, 21 nt, Artificial Sequence
  Description of Artificial Sequence: Synthetic oligonucleotide
  modified_base (20)..(21): a, c, g, u, unknown or other
ucucagugaaggaagaaccnn

SEQ ID NO: 2867 - RNA, 21 nt, Artificial Sequence
  Description of Artificial Sequence: Synthetic oligonucleotide
  modified_base (20)..(21): a, c, g, u, unknown or other
cucagugaaggaagaaccunn

SEQ ID NO: 2868 - RNA, 21 nt, Artificial Sequence
  Description of Artificial Sequence: Synthetic oligonucleotide
  modified_base (20)..(21): a, c, g, u, unknown or other
ucagugaaggaagaaccugnn

SEQ ID NO: 2869 - RNA, 21 nt, Artificial Sequence
  Description of Artificial Sequence: Synthetic oligonucleotide
  modified_base (20)..(21): a, c, g, u, unknown or other
cagugaaggaagaaccugunn

SEQ ID NO: 2870 - RNA, 21 nt, Artificial Sequence
  Description of Artificial Sequence: Synthetic oligonucleotide
  modified_base (20)..(21): a, c, g, u, unknown or other
agugaaggaagaaccuguann

SEQ ID NO: 2871 - RNA, 21 nt, Artificial Sequence
  Description of Artificial Sequence: Synthetic oligonucleotide
  modified_base (20)..(21): a, c, g, u, unknown or other
gugaaggaagaaccuguagnn

SEQ ID NO: 2872 - RNA, 21 nt, Artificial Sequence
  Description of Artificial Sequence: Synthetic oligonucleotide
  modified_base (20)..(21): a, c, g, u, unknown or other
ugaaggaagaaccuguagann

SEQ ID NO: 2873 - RNA, 21 nt, Artificial Sequence
  Description of Artificial Sequence: Synthetic oligonucleotide
  modified_base (20)..(21): a, c, g, u, unknown or other
gaaggaagaaccuguagaann

SEQ ID NO: 2874 - RNA, 21 nt, Artificial Sequence
  Description of Artificial Sequence: Synthetic oligonucleotide
  modified_base (20)..(21): a, c, g, u, unknown or other
aaggaagaaccuguagaagnn

SEQ ID NO: 2875 - RNA, 21 nt, Artificial Sequence
  Description of Artificial Sequence: Synthetic oligonucleotide
  modified_base (20)..(21): a, c, g, u, unknown or other
aggaagaaccuguagaagann

SEQ ID NO: 2876 - RNA, 21 nt, Artificial Sequence
  Description of Artificial Sequence: Synthetic oligonucleotide
  modified_base (20)..(21): a, c, g, u, unknown or other
ggaagaaccuguagaagaunn

SEQ ID NO: 2877 - RNA, 21 nt, Artificial Sequence
  Description of Artificial Sequence: Synthetic oligonucleotide
  modified_base (20)..(21): a, c, g, u, unknown or other
gaagaaccuguagaagaugnn

SEQ ID NO: 2878 - RNA, 21 nt, Artificial Sequence
  Description of Artificial Sequence: Synthetic oligonucleotide
  modified_base (20)..(21): a, c, g, u, unknown or other
aagaaccuguagaagaugann

SEQ ID NO: 2879 - RNA, 21 nt, Artificial Sequence
  Description of Artificial Sequence: Synthetic oligonucleotide
  modified_base (20)..(21): a, c, g, u, unknown or other
agaaccuguagaagaugacnn

SEQ ID NO: 2880 - RNA, 21 nt, Artificial Sequence
  Description of Artificial Sequence: Synthetic oligonucleotide
  modified_base (20)..(21): a, c, g, u, unknown or other
gaaccuguagaagaugaccnn

SEQ ID NO: 2881 - RNA, 21 nt, Artificial Sequence
  Description of Artificial Sequence: Synthetic oligonucleotide
  modified_base (20)..(21): a, c, g, u, unknown or other
aaccuguagaagaugaccunn

SEQ ID NO: 2882 - RNA, 21 nt, Artificial Sequence
  Description of Artificial Sequence: Synthetic oligonucleotide
  modified_base (20)..(21): a, c, g, u, unknown or other
accuguagaagaugaccucnn

SEQ ID NO: 2883 - RNA, 21 nt, Artificial Sequence
  Description of Artificial Sequence: Synthetic oligonucleotide
  modified_base (20)..(21): a, c, g, u, unknown or other
gcugccccgacagaagcagnn

SEQ ID NO: 2884 - RNA, 21 nt, Artificial Sequence
  Description of Artificial Sequence: Synthetic oligonucleotide
  modified_base (20)..(21): a, c, g, u, unknown or other
gauuugagauacccagcucnn

SEQ ID NO: 2885 - RNA, 21 nt, Artificial Sequence
  Description of Artificial Sequence: Synthetic oligonucleotide
  modified_base (20)..(21): a, c, g, u, unknown or other
ggcugccccgacagaagcann

SEQ ID NO: 2886 - RNA, 21 nt, Artificial Sequence
  Description of Artificial Sequence: Synthetic oligonucleotide
  modified_base (20)..(21): a, c, g, u, unknown or other
agauuugagauacccagcunn

SEQ ID NO: 2887 - RNA, 21 nt, Artificial Sequence
  Description of Artificial Sequence: Synthetic oligonucleotide
  modified_base (20)..(21): a, c, g, u, unknown or other
cagauuugagauacccagcnn

SEQ ID NO: 2888 - RNA, 21 nt, Artificial Sequence
  Description of Artificial Sequence: Synthetic oligonucleotide
  modified_base (20)..(21): a, c, g, u, unknown or other
gcagauuugagauacccagnn

SEQ ID NO: 2889 - RNA, 21 nt, Artificial Sequence
  Description of Artificial Sequence: Synthetic oligonucleotide
  modified_base (20)..(21): a, c, g, u, unknown or other
agcagauuugagauacccann

SEQ ID NO: 2890 - RNA, 21 nt, Artificial Sequence
  Description of Artificial Sequence: Synthetic oligonucleotide
  modified_base (20)..(21): a, c, g, u, unknown or other
aagcagauuugagauacccnn

SEQ ID NO: 2891 - RNA, 21 nt, Artificial Sequence
  Description of Artificial Sequence: Synthetic oligonucleotide
  modified_base (20)..(21): a, c, g, u, unknown or other
aaagcagauuugagauaccnn

SEQ ID NO: 2892 - RNA, 21 nt, Artificial Sequence
  Description of Artificial Sequence: Synthetic oligonucleotide
  modified_base (20)..(21): a, c, g, u, unknown or other
gaaagcagauuugagauacnn

SEQ ID NO: 2893 - RNA, 21 nt, Artificial Sequence
  Description of Artificial Sequence: Synthetic oligonucleotide
  modified_base (20)..(21): a, c, g, u, unknown or other
ugaaagcagauuugagauann

SEQ ID NO: 2894 - RNA, 21 nt, Artificial Sequence
  Description of Artificial Sequence: Synthetic oligonucleotide
  modified_base (20)..(21): a, c, g, u, unknown or other
augaaagcagauuugagaunn

SEQ ID NO: 2895 - RNA, 21 nt, Artificial Sequence
  Description of Artificial Sequence: Synthetic oligonucleotide
  modified_base (20)..(21): a, c, g, u, unknown or other
gaugaaagcagauuugagann

SEQ ID NO: 2896 - RNA, 21 nt, Artificial Sequence
  Description of Artificial Sequence: Synthetic oligonucleotide
  modified_base (20)..(21): a, c, g, u, unknown or other
gggcugccccgacagaagcnn

SEQ ID NO: 2897 - RNA, 21 nt, Artificial Sequence
  Description of Artificial Sequence: Synthetic oligonucleotide
  modified_base (20)..(21): a, c, g, u, unknown or other
ggaugaaagcagauuugagnn

SEQ ID NO: 2898 - RNA, 21 nt, Artificial Sequence
  Description of Artificial Sequence: Synthetic oligonucleotide
  modified_base (20)..(21): a, c, g, u, unknown or other
uggaugaaagcagauuugann

SEQ ID NO: 2899 - RNA, 21 nt, Artificial Sequence
  Description of Artificial Sequence: Synthetic oligonucleotide
  modified_base (20)..(21): a, c, g, u, unknown or other
cuggaugaaagcagauuugnn

SEQ ID NO: 2900 - RNA, 21 nt, Artificial Sequence
  Description of Artificial Sequence: Synthetic oligonucleotide
  modified_base (20)..(21): a, c, g, u, unknown or other
gcuggaugaaagcagauuunn

SEQ ID NO: 2901 - RNA, 21 nt, Artificial Sequence
  Description of Artificial Sequence: Synthetic oligonucleotide
  modified_base (20)..(21): a, c, g, u, unknown or other
ggcuggaugaaagcagauunn

SEQ ID NO: 2902 - RNA, 21 nt, Artificial Sequence
  Description of Artificial Sequence: Synthetic oligonucleotide
  modified_base (20)..(21): a, c, g, u, unknown or other
uggcuggaugaaagcagaunn

SEQ ID NO: 2903 - RNA, 21 nt, Artificial Sequence
  Description of Artificial Sequence: Synthetic oligonucleotide
  modified_base (20)..(21): a, c, g, u, unknown or other
guggcuggaugaaagcagann

SEQ ID NO: 2904 - RNA, 21 nt, Artificial Sequence
  Description of Artificial Sequence: Synthetic oligonucleotide
  modified_base (20)..(21): a, c, g, u, unknown or other
aguggcuggaugaaagcagnn

SEQ ID NO: 2905 - RNA, 21 nt, Artificial Sequence
  Description of Artificial Sequence: Synthetic oligonucleotide
  modified_base (20)..(21): a, c, g, u, unknown or other
caguggcuggaugaaagcann

SEQ ID NO: 2906 - RNA, 21 nt, Artificial Sequence
  Description of Artificial Sequence: Synthetic oligonucleotide
  modified_base (20)..(21): a, c, g, u, unknown or other
gcaguggcuggaugaaagcnn

SEQ ID NO: 2907 - RNA, 21 nt, Artificial Sequence
  Description of Artificial Sequence: Synthetic oligonucleotide
  modified_base (20)..(21): a, c, g, u, unknown or other
cgggcugccccgacagaagnn

SEQ ID NO: 2908 - RNA, 21 nt, Artificial Sequence
  Description of Artificial Sequence: Synthetic oligonucleotide
  modified_base (20)..(21): a, c, g, u, unknown or other
ggcaguggcuggaugaaagnn

SEQ ID NO: 2909 - RNA, 21 nt, Artificial Sequence
  Description of Artificial Sequence: Synthetic oligonucleotide
  modified_base (20)..(21): a, c, g, u, unknown or other
gggcaguggcuggaugaaann

SEQ ID NO: 2910 - RNA, 21 nt, Artificial Sequence
  Description of Artificial Sequence: Synthetic oligonucleotide
  modified_base (20)..(21): a, c, g, u, unknown or other
gcgggcugccccgacagaann

SEQ ID NO: 2911 - RNA, 21 nt, Artificial Sequence
  Description of Artificial Sequence: Synthetic oligonucleotide
  modified_base (20)..(21): a, c, g, u, unknown or other
ggcgggcugccccgacagann

SEQ ID NO: 2912 - RNA, 21 nt, Artificial Sequence
  Description of Artificial Sequence: Synthetic oligonucleotide
  modified_base (20)..(21): a, c, g, u, unknown or other
ccaguaggcaggaagauggnn

SEQ ID NO: 2913 - RNA, 21 nt, Artificial Sequence
  Description of Artificial Sequence: Synthetic oligonucleotide
  modified_base (20)..(21): a, c, g, u, unknown or other
uccaguaggcaggaagaugnn

SEQ ID NO: 2914 - RNA, 21 nt, Artificial Sequence
  Description of Artificial Sequence: Synthetic oligonucleotide
  modified_base (20)..(21): a, c, g, u, unknown or other
auccaguaggcaggaagaunn

SEQ ID NO: 2915 - RNA, 21 nt, Artificial Sequence
  Description of Artificial Sequence: Synthetic oligonucleotide
  modified_base (20)..(21): a, c, g, u, unknown or other
cauccaguaggcaggaagann

SEQ ID NO: 2916 - RNA, 21 nt, Artificial Sequence
  Description of Artificial Sequence: Synthetic oligonucleotide
  modified_base (20)..(21): a, c, g, u, unknown or other
gcauccaguaggcaggaagnn

SEQ ID NO: 2917 - RNA, 21 nt, Artificial Sequence
  Description of Artificial Sequence: Synthetic oligonucleotide
  modified_base (20)..(21): a, c, g, u, unknown or other
agcauccaguaggcaggaann

SEQ ID NO: 2918 - RNA, 21 nt, Artificial Sequence
  Description of Artificial Sequence: Synthetic oligonucleotide
  modified_base (20)..(21): a, c, g, u, unknown or other
aggcgggcugccccgacagnn

SEQ ID NO: 2919 - RNA, 21 nt, Artificial Sequence
  Description of Artificial Sequence: Synthetic oligonucleotide
  modified_base (20)..(21): a, c, g, u, unknown or other
aagcauccaguaggcaggann

SEQ ID NO: 2920 - RNA, 21 nt, Artificial Sequence
  Description of Artificial Sequence: Synthetic oligonucleotide
  modified_base (20)..(21): a, c, g, u, unknown or other
uaagcauccaguaggcaggnn

SEQ ID NO: 2921 - RNA, 21 nt, Artificial Sequence
  Description of Artificial Sequence: Synthetic oligonucleotide
  modified_base (20)..(21): a, c, g, u, unknown or other
guaagcauccaguaggcagnn

SEQ ID NO: 2922 - RNA, 21 nt, Artificial Sequence
  Description of Artificial Sequence: Synthetic oligonucleotide
  modified_base (20)..(21): a, c, g, u, unknown or other
uguaagcauccaguaggcann

SEQ ID NO: 2923 - RNA, 21 nt, Artificial Sequence
  Description of Artificial Sequence: Synthetic oligonucleotide
  modified_base (20)..(21): a, c, g, u, unknown or other
cuguaagcauccaguaggcnn

SEQ ID NO: 2924 - RNA, 21 nt, Artificial Sequence
  Description of Artificial Sequence: Synthetic oligonucleotide
  modified_base (20)..(21): a, c, g, u, unknown or other
acuguaagcauccaguaggnn

SEQ ID NO: 2925 - RNA, 21 nt, Artificial Sequence
  Description of Artificial Sequence: Synthetic oligonucleotide
  modified_base (20)..(21): a, c, g, u, unknown or other
cacuguaagcauccaguagnn

SEQ ID NO: 2926 - RNA, 21 nt, Artificial Sequence
  Description of Artificial Sequence: Synthetic oligonucleotide
  modified_base (20)..(21): a, c, g, u, unknown or other
ucacuguaagcauccaguann

SEQ ID NO: 2927 - RNA, 21 nt, Artificial Sequence
  Description of Artificial Sequence: Synthetic oligonucleotide
  modified_base (20)..(21): a, c, g, u, unknown or other
gucacuguaagcauccagunn

SEQ ID NO: 2928 - RNA, 21 nt, Artificial Sequence
  Description of Artificial Sequence: Synthetic oligonucleotide
  modified_base (20)..(21): a, c, g, u, unknown or other
agucacuguaagcauccagnn

SEQ ID NO: 2929 - RNA, 21 nt, Artificial Sequence
  Description of Artificial Sequence: Synthetic oligonucleotide
  modified_base (20)..(21): a, c, g, u, unknown or other
gaggcgggcugccccgacann

SEQ ID NO: 2930 - RNA, 21 nt, Artificial Sequence
  Description of Artificial Sequence: Synthetic oligonucleotide
  modified_base (20)..(21): a, c, g, u, unknown or other
cagucacuguaagcauccann

SEQ ID NO: 2931 - RNA, 21 nt, Artificial Sequence
  Description of Artificial Sequence: Synthetic oligonucleotide
  modified_base (20)..(21): a, c, g, u, unknown or other
acagucacuguaagcauccnn

SEQ ID NO: 2932 - RNA, 21 nt, Artificial Sequence
  Description of Artificial Sequence: Synthetic oligonucleotide
  modified_base (20)..(21): a, c, g, u, unknown or other
cacagucacuguaagcaucnn

SEQ ID NO: 2933 - RNA, 21 nt, Artificial Sequence
  Description of Artificial Sequence: Synthetic oligonucleotide
  modified_base (20)..(21): a, c, g, u, unknown or other
ccacagucacuguaagcaunn

SEQ ID NO: 2934 - RNA, 21 nt, Artificial Sequence
  Description of Artificial Sequence: Synthetic oligonucleotide
  modified_base (20)..(21): a, c, g, u, unknown or other
uccacagucacuguaagcann

SEQ ID NO: 2935 - RNA, 21 nt, Artificial Sequence
  Description of Artificial Sequence: Synthetic oligonucleotide
  modified_base (20)..(21): a, c, g, u, unknown or other
auccacagucacuguaagcnn

SEQ ID NO: 2936 - RNA, 21 nt, Artificial Sequence
  Description of Artificial Sequence: Synthetic oligonucleotide
  modified_base (20)..(21): a, c, g, u, unknown or other
uauccacagucacuguaagnn

SEQ ID NO: 2937 - RNA, 21 nt, Artificial Sequence
  Description of Artificial Sequence: Synthetic oligonucleotide
  modified_base (20)..(21): a, c, g, u, unknown or other
ggaggcgggcugccccgacnn

SEQ ID NO: 2938 - RNA, 21 nt, Artificial Sequence
  Description of Artificial Sequence: Synthetic oligonucleotide
  modified_base (20)..(21): a, c, g, u, unknown or other
cggaggcgggcugccccgann

SEQ ID NO: 2939 - RNA, 21 nt, Artificial Sequence
  Description of Artificial Sequence: Synthetic oligonucleotide
  modified_base (20)..(21): a, c, g, u, unknown or other
gcggaggcgggcugccccgnn

SEQ ID NO: 2940 - RNA, 21 nt, Artificial Sequence
  Description of Artificial Sequence: Synthetic oligonucleotide
  modified_base (20)..(21): a, c, g, u, unknown or other
ggcggaggcgggcugccccnn

SEQ ID NO: 2941 - RNA, 21 nt, Artificial Sequence
  Description of Artificial Sequence: Synthetic oligonucleotide
  modified_base (20)..(21): a, c, g, u, unknown or other
gagaggacaugucacugaann

SEQ ID NO: 2942 - RNA, 21 nt, Artificial Sequence
  Description of Artificial Sequence: Synthetic oligonucleotide
  modified_base (20)..(21): a, c, g, u, unknown or other
cggcggaggcgggcugcccnn

SEQ ID NO: 2943 - RNA, 21 nt, Artificial Sequence
  Description of Artificial Sequence: Synthetic oligonucleotide
  modified_base (20)..(21): a, c, g, u, unknown or other
gcggcggaggcgggcugccnn

SEQ ID NO: 2944 - RNA, 21 nt, Artificial Sequence
  Description of Artificial Sequence: Synthetic oligonucleotide
  modified_base (20)..(21): a, c, g, u, unknown or other
agaaugguuuacaccaagcnn

SEQ ID NO: 2945 - RNA, 21 nt, Artificial Sequence
  Description of Artificial Sequence: Synthetic oligonucleotide
  modified_base (20)..(21): a, c, g, u, unknown or other
aagaaugguuuacaccaagnn

SEQ ID NO: 2946 - RNA, 21 nt, Artificial Sequence
  Description of Artificial Sequence: Synthetic oligonucleotide
  modified_base (20)..(21): a, c, g, u, unknown or other
caagaaugguuuacaccaann

SEQ ID NO: 2947 - RNA, 21 nt, Artificial Sequence
  Description of Artificial Sequence: Synthetic oligonucleotide
  modified_base (20)..(21): a, c, g, u, unknown or other
ccaagaaugguuuacaccann

SEQ ID NO: 2948 - RNA, 21 nt, Artificial Sequence
  Description of Artificial Sequence: Synthetic oligonucleotide
  modified_base (20)..(21): a, c, g, u, unknown or other
cccaagaaugguuuacaccnn

SEQ ID NO: 2949 - RNA, 21 nt, Artificial Sequence
  Description of Artificial Sequence: Synthetic oligonucleotide
  modified_base (20)..(21): a, c, g, u, unknown or other
ucccaagaaugguuuacacnn

SEQ ID NO: 2950 - RNA, 21 nt, Artificial Sequence
  Description of Artificial Sequence: Synthetic oligonucleotide
  modified_base (20)..(21): a, c, g, u, unknown or other
ggcggcggaggcgggcugcnn

SEQ ID NO: 2951 - RNA, 21 nt, Artificial Sequence
  Description of Artificial Sequence: Synthetic oligonucleotide
  modified_base (20)..(21): a, c, g, u, unknown or other
cucccaagaaugguuuacann

SEQ ID NO: 2952 - RNA, 21 nt, Artificial Sequence
  Description of Artificial Sequence: Synthetic oligonucleotide
  modified_base (20)..(21): a, c, g, u, unknown or other
ccucccaagaaugguuuacnn

SEQ ID NO: 2953 - RNA, 21 nt, Artificial Sequence
  Description of Artificial Sequence: Synthetic oligonucleotide
  modified_base (20)..(21): a, c, g, u, unknown or other
uccucccaagaaugguuuann

SEQ ID NO: 2954 - RNA, 21 nt, Artificial Sequence
  Description of Artificial Sequence: Synthetic oligonucleotide
  modified_base (20)..(21): a, c, g, u, unknown or other
guccucccaagaaugguuunn

SEQ ID NO: 2955 - RNA, 21 nt, Artificial Sequence
  Description of Artificial Sequence: Synthetic oligonucleotide
  modified_base (20)..(21): a, c, g, u, unknown or other
uguccucccaagaaugguunn

SEQ ID NO: 2956 - RNA, 21 nt, Artificial Sequence
  Description of Artificial Sequence: Synthetic oligonucleotide
  modified_base (20)..(21): a, c, g, u, unknown or other
guguccucccaagaauggunn

SEQ ID NO: 2957 - RNA, 21 nt, Artificial Sequence
  Description of Artificial Sequence: Synthetic oligonucleotide
  modified_base (20)..(21): a, c, g, u, unknown or other
aguguccucccaagaauggnn

SEQ ID NO: 2958 - RNA, 21 nt, Artificial Sequence
  Description of Artificial Sequence: Synthetic oligonucleotide
  modified_base (20)..(21): a, c, g, u, unknown or other
aaguguccucccaagaaugnn

SEQ ID NO: 2959 - RNA, 21 nt, Artificial Sequence
  Description of Artificial Sequence: Synthetic oligonucleotide
  modified_base (20)..(21): a, c, g, u, unknown or other
aaaguguccucccaagaaunn

SEQ ID NO: 2960 - RNA, 21 nt, Artificial Sequence
  Description of Artificial Sequence: Synthetic oligonucleotide
  modified_base (20)..(21): a, c, g, u, unknown or other
aaaaguguccucccaagaann

SEQ ID NO: 2961 - RNA, 21 nt, Artificial Sequence
  Description of Artificial Sequence: Synthetic oligonucleotide
  modified_base (20)..(21): a, c, g, u, unknown or other
cggcggcggaggcgggcugnn

SEQ ID NO: 2962 - RNA, 21 nt, Artificial Sequence
  Description of Artificial Sequence: Synthetic oligonucleotide
  modified_base (20)..(21): a, c, g, u, unknown or other
caaaaguguccucccaagann

SEQ ID NO: 2963 - RNA, 21 nt, Artificial Sequence
  Description of Artificial Sequence: Synthetic oligonucleotide
  modified_base (20)..(21): a, c, g, u, unknown or other
gcaaaaguguccucccaagnn

SEQ ID NO: 2964 - RNA, 21 nt, Artificial Sequence
  Description of Artificial Sequence: Synthetic oligonucleotide
  modified_base (20)..(21): a, c, g, u, unknown or other
ggcaaaaguguccucccaann

SEQ ID NO: 2965 - RNA, 21 nt, Artificial Sequence
  Description of Artificial Sequence: Synthetic oligonucleotide
  modified_base (20)..(21): a, c, g, u, unknown or other
uggcaaaaguguccucccann

SEQ ID NO: 2966 - RNA, 21 nt, Artificial Sequence
  Description of Artificial Sequence: Synthetic oligonucleotide
  modified_base (20)..(21): a, c, g, u, unknown or other
uuggcaaaaguguccucccnn

SEQ ID NO: 2967 - RNA, 21 nt, Artificial Sequence
  Description of Artificial Sequence: Synthetic oligonucleotide
  modified_base (20)..(21): a, c, g, u, unknown or other
auuggcaaaaguguccuccnn

SEQ ID NO: 2968 - RNA, 21 nt, Artificial Sequence
  Description of Artificial Sequence: Synthetic oligonucleotide
  modified_base (20)..(21): a, c, g, u, unknown or other
cauuggcaaaaguguccucnn

SEQ ID NO: 2969 - RNA, 21 nt, Artificial Sequence
  Description of Artificial Sequence: Synthetic oligonucleotide
  modified_base (20)..(21): a, c, g, u, unknown or other
ucauuggcaaaaguguccunn

SEQ ID NO: 2970 - RNA, 21 nt, Artificial Sequence
  Description of Artificial Sequence: Synthetic oligonucleotide
  modified_base (20)..(21): a, c, g, u, unknown or other
uucauuggcaaaaguguccnn

SEQ ID NO: 2971 - RNA, 21 nt, Artificial Sequence
  Description of Artificial Sequence: Synthetic oligonucleotide
  modified_base (20)..(21): a, c, g, u, unknown or other
guucauuggcaaaagugucnn

SEQ ID NO: 2972 - RNA, 21 nt, Artificial Sequence
  Description of Artificial Sequence: Synthetic oligonucleotide
  modified_base (20)..(21): a, c, g, u, unknown or other
ccggcggcggaggcgggcunn

SEQ ID NO: 2973 - RNA, 21 nt, Artificial Sequence
  Description of Artificial Sequence: Synthetic oligonucleotide
  modified_base (20)..(21): a, c, g, u, unknown or other
aguucauuggcaaaagugunn

SEQ ID NO: 2974 - RNA, 21 nt, Artificial Sequence
  Description of Artificial Sequence: Synthetic oligonucleotide
  modified_base (20)..(21): a, c, g, u, unknown or other
uccggcggcggaggcgggcnn

SEQ ID NO: 2975 - RNA, 21 nt, Artificial Sequence
  Description of Artificial Sequence: Synthetic oligonucleotide
  modified_base (20)..(21): a, c, g, u, unknown or other
cuccggcggcggaggcgggnn

SEQ ID NO: 2976 - RNA, 21 nt, Artificial Sequence
  Description of Artificial Sequence: Synthetic oligonucleotide
  modified_base (20)..(21): a, c, g, u, unknown or other
cacuaaucagcuggggaaann

SEQ ID NO: 2977 - RNA, 21 nt, Artificial Sequence
  Description of Artificial Sequence: Synthetic oligonucleotide
  modified_base (20)..(21): a, c, g, u, unknown or other
acacuaaucagcuggggaann

SEQ ID NO: 2978 - RNA, 21 nt, Artificial Sequence
  Description of Artificial Sequence: Synthetic oligonucleotide
  modified_base (20)..(21): a, c, g, u, unknown or other
gacacuaaucagcuggggann

SEQ ID NO: 2979 - RNA, 21 nt, Artificial Sequence
  Description of Artificial Sequence: Synthetic oligonucleotide
  modified_base (20)..(21): a, c, g, u, unknown or other
agacacuaaucagcuggggnn

SEQ ID NO: 2980 - RNA, 21 nt, Artificial Sequence
  Description of Artificial Sequence: Synthetic oligonucleotide
  modified_base (20)..(21): a, c, g, u, unknown or other
uagacacuaaucagcugggnn

SEQ ID NO: 2981 - RNA, 21 nt, Artificial Sequence
  Description of Artificial Sequence: Synthetic oligonucleotide
  modified_base (20)..(21): a, c, g, u, unknown or other
uuagacacuaaucagcuggnn

SEQ ID NO: 2982 - RNA, 21 nt, Artificial Sequence
  Description of Artificial Sequence: Synthetic oligonucleotide
  modified_base (20)..(21): a, c, g, u, unknown or other
cuuagacacuaaucagcugnn

SEQ ID NO: 2983 - RNA, 21 nt, Artificial Sequence
  Description of Artificial Sequence: Synthetic oligonucleotide
  modified_base (20)..(21): a, c, g, u, unknown or other
ccuuagacacuaaucagcunn

SEQ ID NO: 2984 - RNA, 21 nt, Artificial Sequence
  Description of Artificial Sequence: Synthetic oligonucleotide
  modified_base (20)..(21): a, c, g, u, unknown or other
uccuuagacacuaaucagcnn

SEQ ID NO: 2985 - RNA, 21 nt, Artificial Sequence
  Description of Artificial Sequence: Synthetic oligonucleotide
  modified_base (20)..(21): a, c, g, u, unknown or other
uuccuuagacacuaaucagnn

SEQ ID NO: 2986 - RNA, 21 nt, Artificial Sequence
  Description of Artificial Sequence: Synthetic oligonucleotide
  modified_base (20)..(21): a, c, g, u, unknown or other
gcuccggcggcggaggcggnn

SEQ ID NO: 2987 - RNA, 21 nt, Artificial Sequence
  Description of Artificial Sequence: Synthetic oligonucleotide
  modified_base (20)..(21): a, c, g, u, unknown or other
auuccuuagacacuaaucann

SEQ ID NO: 2988 - RNA, 21 nt, Artificial Sequence
  Description of Artificial Sequence: Synthetic oligonucleotide
  modified_base (20)..(21): a, c, g, u, unknown or other
cauuccuuagacacuaaucnn

SEQ ID NO: 2989 - RNA, 21 nt, Artificial Sequence
  Description of Artificial Sequence: Synthetic oligonucleotide
  modified_base (20)..(21): a, c, g, u, unknown or other
ucauuccuuagacacuaaunn

SEQ ID NO: 2990 - RNA, 21 nt, Artificial Sequence
  Description of Artificial Sequence: Synthetic oligonucleotide
  modified_base (20)..(21): a, c, g, u, unknown or other
aucauuccuuagacacuaann

SEQ ID NO: 2991 - RNA, 21 nt, Artificial Sequence
  Description of Artificial Sequence: Synthetic oligonucleotide
  modified_base (20)..(21): a, c, g, u, unknown or other
gaucauuccuuagacacuann

SEQ ID NO: 2992 - RNA, 21 nt, Artificial Sequence
  Description of Artificial Sequence: Synthetic oligonucleotide
  modified_base (20)..(21): a, c, g, u, unknown or other
ggaucauuccuuagacacunn

SEQ ID NO: 2993 - RNA, 21 nt, Artificial Sequence
  Description of Artificial Sequence: Synthetic oligonucleotide
  modified_base (20)..(21): a, c, g, u, unknown or other
uggaucauuccuuagacacnn

SEQ ID NO: 2994 - RNA, 21 nt, Artificial Sequence
  Description of Artificial Sequence: Synthetic oligonucleotide
  modified_base (20)..(21): a, c, g, u, unknown or other
ggcuccggcggcggaggcgnn

SEQ ID NO: 2995 - RNA, 21 nt, Artificial Sequence
  Description of Artificial Sequence: Synthetic oligonucleotide
  modified_base (20)..(21): a, c, g, u, unknown or other
gggcuccggcggcggaggcnn

SEQ ID NO: 2996 - RNA, 21 nt, Artificial Sequence
  Description of Artificial Sequence: Synthetic oligonucleotide
  modified_base (20)..(21): a, c, g, u, unknown or other
aaggaaaagggcaacaguann

SEQ ID NO: 2997 - RNA, 21 nt, Artificial Sequence
  Description of Artificial Sequence: Synthetic oligonucleotide
  modified_base (20)..(21): a, c, g, u, unknown or other
caaggaaaagggcaacagunn

SEQ ID NO: 2998 - RNA, 21 nt, Artificial Sequence
  Description of Artificial Sequence: Synthetic oligonucleotide
  modified_base (20)..(21): a, c, g, u, unknown or other
ucaaggaaaagggcaacagnn

SEQ ID NO: 2999 - RNA, 21 nt, Artificial Sequence
  Description of Artificial Sequence: Synthetic oligonucleotide
  modified_base (20)..(21): a, c, g, u, unknown or other
gucaaggaaaagggcaacann

SEQ ID NO: 3000 - RNA, 21 nt, Artificial Sequence
  Description of Artificial Sequence: Synthetic oligonucleotide
  modified_base (20)..(21): a, c, g, u, unknown or other
ggggcuccggcggcggaggnn

SEQ ID NO: 3001 - RNA, 21 nt, Artificial Sequence
  Description of Artificial Sequence: Synthetic oligonucleotide
  modified_base (20)..(21): a, c, g, u, unknown or other
agucaaggaaaagggcaacnn

SEQ ID NO: 3002 - RNA, 21 nt, Artificial Sequence
  Description of Artificial Sequence: Synthetic oligonucleotide
  modified_base (20)..(21): a, c, g, u, unknown or other
uagucaaggaaaagggcaann

SEQ ID NO: 3003 - RNA, 21 nt, Artificial Sequence
  Description of Artificial Sequence: Synthetic oligonucleotide
  modified_base (20)..(21): a, c, g, u, unknown or other
auagucaaggaaaagggcann

SEQ ID NO: 3004 - RNA, 21 nt, Artificial Sequence
  Description of Artificial Sequence: Synthetic oligonucleotide
  modified_base (20)..(21): a, c, g, u, unknown or other
aauagucaaggaaaagggcnn

SEQ ID NO: 3005 - RNA, 21 nt, Artificial Sequence
  Description of Artificial Sequence: Synthetic oligonucleotide
  modified_base (20)..(21): a, c, g, u, unknown or other
uaauagucaaggaaaagggnn

SEQ ID NO: 3006 - RNA, 21 nt, Artificial Sequence
  Description of Artificial Sequence: Synthetic oligonucleotide
  modified_base (20)..(21): a, c, g, u, unknown or other
guaauagucaaggaaaaggnn

SEQ ID NO: 3007 - RNA, 21 nt, Artificial Sequence
  Description of Artificial Sequence: Synthetic oligonucleotide
  modified_base (20)..(21): a, c, g, u, unknown or other
uguaauagucaaggaaaagnn

SEQ ID NO: 3008 - RNA, 21 nt, Artificial Sequence
  Description of Artificial Sequence: Synthetic oligonucleotide
  modified_base (20)..(21): a, c, g, u, unknown or other
guguaauagucaaggaaaann

SEQ ID NO: 3009 - RNA, 21 nt, Artificial Sequence
  Description of Artificial Sequence: Synthetic oligonucleotide
  modified_base (20)..(21): a, c, g, u, unknown or other
aguguaauagucaaggaaann

SEQ ID NO: 3010 - RNA, 21 nt, Artificial Sequence
  Description of Artificial Sequence: Synthetic oligonucleotide
  modified_base (20)..(21): a, c, g, u, unknown or other
caguguaauagucaaggaann

SEQ ID NO: 3011 - RNA, 21 nt, Artificial Sequence
  Description of Artificial Sequence: Synthetic oligonucleotide
  modified_base (20)..(21): a, c, g, u, unknown or other
cggggcuccggcggcggagnn

SEQ ID NO: 3012 - RNA, 21 nt, Artificial Sequence
  Description of Artificial Sequence: Synthetic oligonucleotide
  modified_base (20)..(21): a, c, g, u, unknown or other
gcaguguaauagucaaggann

SEQ ID NO: 3013 - RNA, 21 nt, Artificial Sequence
  Description of Artificial Sequence: Synthetic oligonucleotide
  modified_base (20)..(21): a, c, g, u, unknown or other
ggcaguguaauagucaaggnn

SEQ ID NO: 3014 - RNA, 21 nt, Artificial Sequence
  Description of Artificial Sequence: Synthetic oligonucleotide
  modified_base (20)..(21): a, c, g, u, unknown or other
aggcaguguaauagucaagnn

SEQ ID NO: 3015 - RNA, 21 nt, Artificial Sequence
  Description of Artificial Sequence: Synthetic oligonucleotide
  modified_base (20)..(21): a, c, g, u, unknown or other
caggcaguguaauagucaann

SEQ ID NO: 3016 - RNA, 21 nt, Artificial Sequence
  Description of Artificial Sequence: Synthetic oligonucleotide
  modified_base (20)..(21): a, c, g, u, unknown or other
ccaggcaguguaauagucann

SEQ ID NO: 3017 - RNA, 21 nt, Artificial Sequence
  Description of Artificial Sequence: Synthetic oligonucleotide
  modified_base (20)..(21): a, c, g, u, unknown or other
uccaggcaguguaauagucnn

SEQ ID NO: 3018 - RNA, 21 nt, Artificial Sequence
  Description of Artificial Sequence: Synthetic oligonucleotide
  modified_base (20)..(21): a, c, g, u, unknown or other
cuccaggcaguguaauagunn

SEQ ID NO: 3019 - RNA, 21 nt, Artificial Sequence
  Description of Artificial Sequence: Synthetic oligonucleotide
  modified_base (20)..(21): a, c, g, u, unknown or other
ccuccaggcaguguaauagnn

SEQ ID NO: 3020 - RNA, 21 nt, Artificial Sequence
  Description of Artificial Sequence: Synthetic oligonucleotide
  modified_base (20)..(21): a, c, g, u, unknown or other
uccuccaggcaguguaauann

SEQ ID NO: 3021 - RNA, 21 nt, Artificial Sequence
  Description of Artificial Sequence: Synthetic oligonucleotide
  modified_base (20)..(21): a, c, g, u, unknown or other
auccuccaggcaguguaaunn

SEQ ID NO: 3022 - RNA, 21 nt, Artificial Sequence
  Description of Artificial Sequence: Synthetic oligonucleotide
  modified_base (20)..(21): a, c, g, u, unknown or other
ccggggcuccggcggcggann

SEQ ID NO: 3023 - RNA, 21 nt, Artificial Sequence
  Description of Artificial Sequence: Synthetic oligonucleotide
  modified_base (20)..(21): a, c, g, u, unknown or other
uauccuccaggcaguguaann

SEQ ID NO: 3024 - RNA, 21 nt, Artificial Sequence
  Description of Artificial Sequence: Synthetic oligonucleotide
  modified_base (20)..(21): a, c, g, u, unknown or other
cuauccuccaggcaguguann

SEQ ID NO: 3025 - RNA, 21 nt, Artificial Sequence
  Description of Artificial Sequence: Synthetic oligonucleotide
  modified_base (20)..(21): a, c, g, u, unknown or other
gcuauccuccaggcagugunn

SEQ ID NO: 3026 - RNA, 21 nt, Artificial Sequence
  Description of Artificial Sequence: Synthetic oligonucleotide
  modified_base (20)..(21): a, c, g, u, unknown or other
ugcuauccuccaggcagugnn

SEQ ID NO: 3027 - RNA, 21 nt, Artificial Sequence
  Description of Artificial Sequence: Synthetic oligonucleotide
  modified_base (20)..(21): a, c, g, u, unknown or other
cugcuauccuccaggcagunn

SEQ ID NO: 3028 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
gccggggctccggcggcggnn

SEQ ID NO: 3029 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ggccggggctccggcggcgnn

SEQ ID NO: 3030 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
cggccggggctccggcggcnn

SEQ ID NO: 3031 - RNA, 21 nt, Artificial Sequence
  Description of Artificial Sequence: Synthetic oligonucleotide
  modified_base (20)..(21): a, c, g, u, unknown or other
uuuggcuuuuugaaugaagnn

SEQ ID NO: 3032 - RNA, 21 nt, Artificial Sequence
  Description of Artificial Sequence: Synthetic oligonucleotide
  modified_base (20)..(21): a, c, g, u, unknown or other
uuuuggcuuuuugaaugaann

SEQ ID NO: 3033 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ccggccggggctccggcggnn

SEQ ID NO: 3034 - RNA, 21 nt, Artificial Sequence
  Description of Artificial Sequence: Synthetic oligonucleotide
  modified_base (20)..(21): a, c, g, u, unknown or other
auuuuggcuuuuugaaugann

SEQ ID NO: 3035 - RNA, 21 nt, Artificial Sequence
  Description of Artificial Sequence: Synthetic oligonucleotide
  modified_base (20)..(21): a, c, g, u, unknown or other
uauuuuggcuuuuugaaugnn

SEQ ID NO: 3036 - RNA, 21 nt, Artificial Sequence
  Description of Artificial Sequence: Synthetic oligonucleotide
  modified_base (20)..(21): a, c, g, u, unknown or other
cuauuuuggcuuuuugaaunn

SEQ ID NO: 3037 - RNA, 21 nt, Artificial Sequence
  Description of Artificial Sequence: Synthetic oligonucleotide
  modified_base (20)..(21): a, c, g, u, unknown or other
ucuauuuuggcuuuuugaann

SEQ ID NO: 3038 - RNA, 21 nt, Artificial Sequence
  Description of Artificial Sequence: Synthetic oligonucleotide
  modified_base (20)..(21): a, c, g, u, unknown or other
cucuauuuuggcuuuuugann

SEQ ID NO: 3039 - RNA, 21 nt, Artificial Sequence
  Description of Artificial Sequence: Synthetic oligonucleotide
  modified_base (20)..(21): a, c, g, u, unknown or other
ucucuauuuuggcuuuuugnn

SEQ ID NO: 3040 - RNA, 21 nt, Artificial Sequence
  Description of Artificial Sequence: Synthetic oligonucleotide
  modified_base (20)..(21): a, c, g, u, unknown or other
cucucuauuuuggcuuuuunn

SEQ ID NO: 3041 - RNA, 21 nt, Artificial Sequence
  Description of Artificial Sequence: Synthetic oligonucleotide
  modified_base (20)..(21): a, c, g, u, unknown or other
acucucuauuuuggcuuuunn

SEQ ID NO: 3042 - RNA, 21 nt, Artificial Sequence
  Description of Artificial Sequence: Synthetic oligonucleotide
  modified_base (20)..(21): a, c, g, u, unknown or other
uacucucuauuuuggcuuunn

SEQ ID NO: 3043 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
gccggccggggctccggcgnn

SEQ ID NO: 3044 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ggccggccggggctccggcnn

SEQ ID NO: 3045 - RNA, 21 nt, Artificial Sequence
  Description of Artificial Sequence: Synthetic oligonucleotide
  modified_base (20)..(21): a, c, g, u, unknown or other
aggaauucucuaggacugunn

SEQ ID NO: 3046 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
tggccggccggggctccggnn

SEQ ID NO: 3047 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ctggccggccggggctccgnn

SEQ ID NO: 3048 - RNA, 21 nt, Artificial Sequence
  Description of Artificial Sequence: Synthetic oligonucleotide
  modified_base (20)..(21): a, c, g, u, unknown or other
uaugagaucugaacaaauann

SEQ ID NO: 3049 - RNA, 21 nt, Artificial Sequence
  Description of Artificial Sequence: Synthetic oligonucleotide
  modified_base (20)..(21): a, c, g, u, unknown or other
cuaugagaucugaacaaaunn

SEQ ID NO: 3050 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
cctggccggccggggctccnn

SEQ ID NO: 3051 - RNA, 21 nt, Artificial Sequence
  Description of Artificial Sequence: Synthetic oligonucleotide
  modified_base (20)..(21): a, c, g, u, unknown or other
ucuaugagaucugaacaaann

SEQ ID NO: 3052 - RNA, 21 nt, Artificial Sequence
  Description of Artificial Sequence: Synthetic oligonucleotide
  modified_base (20)..(21): a, c, g, u, unknown or other
aucuaugagaucugaacaann

SEQ ID NO: 3053 - RNA, 21 nt, Artificial Sequence
  Description of Artificial Sequence: Synthetic oligonucleotide
  modified_base (20)..(21): a, c, g, u, unknown or other
caucuaugagaucugaacann

SEQ ID NO: 3054 - RNA, 21 nt, Artificial Sequence
  Description of Artificial Sequence: Synthetic oligonucleotide
  modified_base (20)..(21): a, c, g, u, unknown or other
ucaucuaugagaucugaacnn

SEQ ID NO: 3055 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
gcctggccggccggggctcnn

SEQ ID NO: 3056 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ggcctggccggccggggctnn

SEQ ID NO: 3057 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
gggcctggccggccggggcnn

SEQ ID NO: 3058 - RNA, 21 nt, Artificial Sequence
  Description of Artificial Sequence: Synthetic oligonucleotide
  modified_base (20)..(21): a, c, g, u, unknown or other
ugcuggaugucaaaagacann

SEQ ID NO: 3059 - RNA, 21 nt, Artificial Sequence
  Description of Artificial Sequence: Synthetic oligonucleotide
  modified_base (20)..(21): a, c, g, u, unknown or other
cugcuggaugucaaaagacnn

SEQ ID NO: 3060 - RNA, 21 nt, Artificial Sequence
  Description of Artificial Sequence: Synthetic oligonucleotide
  modified_base (20)..(21): a, c, g, u, unknown or other
acugcuggaugucaaaagann

SEQ ID NO: 3061 - RNA, 21 nt, Artificial Sequence
  Description of Artificial Sequence: Synthetic oligonucleotide
  modified_base (20)..(21): a, c, g, u, unknown or other
gacugcuggaugucaaaagnn

SEQ ID NO: 3062 - RNA, 21 nt, Artificial Sequence
  Description of Artificial Sequence: Synthetic oligonucleotide
  modified_base (20)..(21): a, c, g, u, unknown or other
ggacugcuggaugucaaaann

SEQ ID NO: 3063 - RNA, 21 nt, Artificial Sequence
  Description of Artificial Sequence: Synthetic oligonucleotide
  modified_base (20)..(21): a, c, g, u, unknown or other
uggacugcuggaugucaaann

SEQ ID NO: 3064 - RNA, 21 nt, Artificial Sequence
  Description of Artificial Sequence: Synthetic oligonucleotide
  modified_base (20)..(21): a, c, g, u, unknown or other
uuggacugcuggaugucaann

SEQ ID NO: 3065 - RNA, 21 nt, Artificial Sequence
  Description of Artificial Sequence: Synthetic oligonucleotide
  modified_base (20)..(21): a, c, g, u, unknown or other
agggccuggccggccggggnn

SEQ ID NO: 3066 - RNA, 21 nt, Artificial Sequence
  Description of Artificial Sequence: Synthetic oligonucleotide
  modified_base (20)..(21): a, c, g, u, unknown or other
cagggccuggccggccgggnn

SEQ ID NO: 3067 - RNA, 21 nt, Artificial Sequence
  Description of Artificial Sequence: Synthetic oligonucleotide
  modified_base (20)..(21): a, c, g, u, unknown or other
caguaauaugucucaauacnn

SEQ ID NO: 3068 - RNA, 21 nt, Artificial Sequence
  Description of Artificial Sequence: Synthetic oligonucleotide
  modified_base (20)..(21): a, c, g, u, unknown or other
gcagggccuggccggccggnn

SEQ ID NO: 3069 - RNA, 21 nt, Artificial Sequence
  Description of Artificial Sequence: Synthetic oligonucleotide
  modified_base (20)..(21): a, c, g, u, unknown or other
ggcagggccuggccggccgnn

SEQ ID NO: 3070 - RNA, 21 nt, Artificial Sequence
  Description of Artificial Sequence: Synthetic oligonucleotide
  modified_base (20)..(21): a, c, g, u, unknown or other
cggcagggccuggccggccnn

SEQ ID NO: 3071 - RNA, 21 nt, Artificial Sequence
  Description of Artificial Sequence: Synthetic oligonucleotide
  modified_base (20)..(21): a, c, g, u, unknown or other
auuauaguaauauuucuuann

SEQ ID NO: 3072 - RNA, 21 nt, Artificial Sequence
  Description of Artificial Sequence: Synthetic oligonucleotide
  modified_base (20)..(21): a, c, g, u, unknown or other
aauuauaguaauauuucuunn

SEQ ID NO: 3073 - RNA, 21 nt, Artificial Sequence
  Description of Artificial Sequence: Synthetic oligonucleotide
  modified_base (20)..(21): a, c, g, u, unknown or other
caauuauaguaauauuucunn

SEQ ID NO: 3074 - RNA, 21 nt, Artificial Sequence
  Description of Artificial Sequence: Synthetic oligonucleotide
  modified_base (20)..(21): a, c, g, u, unknown or other
ucaauuauaguaauauuucnn

SEQ ID NO: 3075 - RNA, 21 nt, Artificial Sequence
  Description of Artificial Sequence: Synthetic oligonucleotide
  modified_base (20)..(21): a, c, g, u, unknown or other
cucaauuauaguaauauuunn

SEQ ID NO: 3076 - RNA, 21 nt, Artificial Sequence
  Description of Artificial Sequence: Synthetic oligonucleotide
  modified_base (20)..(21): a, c, g, u, unknown or other
ucucaauuauaguaauauunn

SEQ ID NO: 3077 - RNA, 21 nt, Artificial Sequence
  Description of Artificial Sequence: Synthetic oligonucleotide
  modified_base (20)..(21): a, c, g, u, unknown or other
uucucaauuauaguaauaunn

SEQ ID NO: 3078 - RNA, 21 nt, Artificial Sequence
  Description of Artificial Sequence: Synthetic oligonucleotide
  modified_base (20)..(21): a, c, g, u, unknown or other
guucucaauuauaguaauann

SEQ ID NO: 3079 - RNA, 21 nt, Artificial Sequence
  Description of Artificial Sequence: Synthetic oligonucleotide
  modified_base (20)..(21): a, c, g, u, unknown or other
gcggcagggccuggccggcnn

SEQ ID NO: 3080 - RNA, 21 nt, Artificial Sequence
  Description of Artificial Sequence: Synthetic oligonucleotide
  modified_base (20)..(21): a, c, g, u, unknown or other
aguucucaauuauaguaaunn

SEQ ID NO: 3081 - RNA, 21 nt, Artificial Sequence
  Description of Artificial Sequence: Synthetic oligonucleotide
  modified_base (20)..(21): a, c, g, u, unknown or other
uaguucucaauuauaguaann

SEQ ID NO: 3082 - RNA, 21 nt, Artificial Sequence
  Description of Artificial Sequence: Synthetic oligonucleotide
  modified_base (20)..(21): a, c, g, u, unknown or other
guaguucucaauuauaguann

SEQ ID NO: 3083 - RNA, 21 nt, Artificial Sequence
  Description of Artificial Sequence: Synthetic oligonucleotide
  modified_base (20)..(21): a, c, g, u, unknown or other
uguaguucucaauuauagunn

SEQ ID NO: 3084 - RNA, 21 nt, Artificial Sequence
  Description of Artificial Sequence: Synthetic oligonucleotide
  modified_base (20)..(21): a, c, g, u, unknown or other
cuguaguucucaauuauagnn

SEQ ID NO: 3085 - RNA, 21 nt, Artificial Sequence
  Description of Artificial Sequence: Synthetic oligonucleotide
  modified_base (20)..(21): a, c, g, u, unknown or other
gcuguaguucucaauuauann

SEQ ID NO: 3086 - RNA, 21 nt, Artificial Sequence
  Description of Artificial Sequence: Synthetic oligonucleotide
  modified_base (20)..(21): a, c, g, u, unknown or other
agcuguaguucucaauuaunn

SEQ ID NO: 3087 - RNA, 21 nt, Artificial Sequence
  Description of Artificial Sequence: Synthetic oligonucleotide
  modified_base (20)..(21): a, c, g, u, unknown or other
aagcuguaguucucaauuann

SEQ ID NO: 3088 - RNA, 21 nt, Artificial Sequence
  Description of Artificial Sequence: Synthetic oligonucleotide
  modified_base (20)..(21): a, c, g, u, unknown or other
aaagcuguaguucucaauunn

SEQ ID NO: 3089 - RNA, 21 nt, Artificial Sequence
  Description of Artificial Sequence: Synthetic oligonucleotide
  modified_base (20)..(21): a, c, g, u, unknown or other
aaaagcuguaguucucaaunn

SEQ ID NO: 3090 - RNA, 21 nt, Artificial Sequence
  Description of Artificial Sequence: Synthetic oligonucleotide
  modified_base (20)..(21): a, c, g, u, unknown or other
agcggcagggccuggccggnn

SEQ ID NO: 3091 - RNA, 21 nt, Artificial Sequence
  Description of Artificial Sequence: Synthetic oligonucleotide
  modified_base (20)..(21): a, c, g, u, unknown or other
uaaaagcuguaguucucaann

SEQ ID NO: 3092 - RNA, 21 nt, Artificial Sequence
  Description of Artificial Sequence: Synthetic oligonucleotide
  modified_base (20)..(21): a, c, g, u, unknown or other
uuaaaagcuguaguucucann

SEQ ID NO: 3093 - RNA, 21 nt, Artificial Sequence
  Description of Artificial Sequence: Synthetic oligonucleotide
  modified_base (20)..(21): a, c, g, u, unknown or other
cuuaaaagcuguaguucucnn

SEQ ID NO: 3094 - RNA, 21 nt, Artificial Sequence
  Description of Artificial Sequence: Synthetic oligonucleotide
  modified_base (20)..(21): a, c, g, u, unknown or other
ucuuaaaagcuguaguucunn

SEQ ID NO: 3095 - RNA, 21 nt, Artificial Sequence
  Description of Artificial Sequence: Synthetic oligonucleotide
  modified_base (20)..(21): a, c, g, u, unknown or other
aucuuaaaagcuguaguucnn

SEQ ID NO: 3096 - RNA, 21 nt, Artificial Sequence
  Description of Artificial Sequence: Synthetic oligonucleotide
  modified_base (20)..(21): a, c, g, u, unknown or other
aaucuuaaaagcuguaguunn

SEQ ID NO: 3097 - RNA, 21 nt, Artificial Sequence
  Description of Artificial Sequence: Synthetic oligonucleotide
  modified_base (20)..(21): a, c, g, u, unknown or other
caaucuuaaaagcuguagunn

SEQ ID NO: 3098 - RNA, 21 nt, Artificial Sequence
  Description of Artificial Sequence: Synthetic oligonucleotide
  modified_base (20)..(21): a, c, g, u, unknown or other
acaaucuuaaaagcuguagnn

SEQ ID NO: 3099 - RNA, 21 nt, Artificial Sequence
  Description of Artificial Sequence: Synthetic oligonucleotide
  modified_base (20)..(21): a, c, g, u, unknown or other
uacaaucuuaaaagcuguann

SEQ ID NO: 3100 - RNA, 21 nt, Artificial Sequence
  Description of Artificial Sequence: Synthetic oligonucleotide
  modified_base (20)..(21): a, c, g, u, unknown or other
guacaaucuuaaaagcugunn

SEQ ID NO: 3101 - RNA, 21 nt, Artificial Sequence
  Description of Artificial Sequence: Synthetic oligonucleotide
  modified_base (20)..(21): a, c, g, u, unknown or other
gagcggcagggccuggccgnn

SEQ ID NO: 3102 - RNA, 21 nt, Artificial Sequence
  Description of Artificial Sequence: Synthetic oligonucleotide
  modified_base (20)..(21): a, c, g, u, unknown or other
aguacaaucuuaaaagcugnn

SEQ ID NO: 3103 - RNA, 21 nt, Artificial Sequence
  Description of Artificial Sequence: Synthetic oligonucleotide
  modified_base (20)..(21): a, c, g, u, unknown or other
aaguacaaucuuaaaagcunn

SEQ ID NO: 3104 - RNA, 21 nt, Artificial Sequence
  Description of Artificial Sequence: Synthetic oligonucleotide
  modified_base (20)..(21): a, c, g, u, unknown or other
aaaguacaaucuuaaaagcnn

SEQ ID NO: 3105 - RNA, 21 nt, Artificial Sequence
  Description of Artificial Sequence: Synthetic oligonucleotide
  modified_base (20)..(21): a, c, g, u, unknown or other
aaaaguacaaucuuaaaagnn

SEQ ID NO: 3106 - RNA, 21 nt, Artificial Sequence
  Description of Artificial Sequence: Synthetic oligonucleotide
  modified_base (20)..(21): a, c, g, u, unknown or other
uaaaaguacaaucuuaaaann

SEQ ID NO: 3107 - RNA, 21 nt, Artificial Sequence
  Description of Artificial Sequence: Synthetic oligonucleotide
  modified_base (20)..(21): a, c, g, u, unknown or other
auaaaaguacaaucuuaaann

SEQ ID NO: 3108 - RNA, 21 nt, Artificial Sequence
  Description of Artificial Sequence: Synthetic oligonucleotide
  modified_base (20)..(21): a, c, g, u, unknown or other
gauaaaaguacaaucuuaann

SEQ ID NO: 3109 - RNA, 21 nt, Artificial Sequence
  Description of Artificial Sequence: Synthetic oligonucleotide
  modified_base (20)..(21): a, c, g, u, unknown or other
agauaaaaguacaaucuuann

SEQ ID NO: 3110 - RNA, 21 nt, Artificial Sequence
  Description of Artificial Sequence: Synthetic oligonucleotide
  modified_base (20)..(21): a, c, g, u, unknown or other
aagauaaaaguacaaucuunn

SEQ ID NO: 3111 - RNA, 21 nt, Artificial Sequence
  Description of Artificial Sequence: Synthetic oligonucleotide
  modified_base (20)..(21): a, c, g, u, unknown or other
uaagauaaaaguacaaucunn

SEQ ID NO: 3112 - RNA, 21 nt, Artificial Sequence
  Description of Artificial Sequence: Synthetic oligonucleotide
  modified_base (20)..(21): a, c, g, u, unknown or other
ugagcggcagggccuggccnn

SEQ ID NO: 3113 - RNA, 21 nt, Artificial Sequence
  Description of Artificial Sequence: Synthetic oligonucleotide
  modified_base (20)..(21): a, c, g, u, unknown or other
uuaagauaaaaguacaaucnn

SEQ ID NO: 3114 - RNA, 21 nt, Artificial Sequence
  Description of Artificial Sequence: Synthetic oligonucleotide
  modified_base (20)..(21): a, c, g, u, unknown or other
uuuaagauaaaaguacaaunn

SEQ ID NO: 3115 - RNA, 21 nt, Artificial Sequence
  Description of Artificial Sequence: Synthetic oligonucleotide
  modified_base (20)..(21): a, c, g, u, unknown or other
uuuuaagauaaaaguacaann

SEQ ID NO: 3116 - RNA, 21 nt, Artificial Sequence
  Description of Artificial Sequence: Synthetic oligonucleotide
  modified_base (20)..(21): a, c, g, u, unknown or other
cuuuuaagauaaaaguacann

SEQ ID NO: 3117 - RNA, 21 nt, Artificial Sequence
  Description of Artificial Sequence: Synthetic oligonucleotide
  modified_base (20)..(21): a, c, g, u, unknown or other
ccuuuuaagauaaaaguacnn

SEQ ID NO: 3118 - RNA, 21 nt, Artificial Sequence
  Description of Artificial Sequence: Synthetic oligonucleotide
  modified_base (20)..(21): a, c, g, u, unknown or other
cccuuuuaagauaaaaguann

SEQ ID NO: 3119 - RNA, 21 nt, Artificial Sequence
  Description of Artificial Sequence: Synthetic oligonucleotide
  modified_base (20)..(21): a, c, g, u, unknown or other
acccuuuuaagauaaaagunn

SEQ ID NO: 3120 - RNA, 21 nt, Artificial Sequence
  Description of Artificial Sequence: Synthetic oligonucleotide
  modified_base (20)..(21): a, c, g, u, unknown or other
cacccuuuuaagauaaaagnn

SEQ ID NO: 3121 - RNA, 21 nt, Artificial Sequence
  Description of Artificial Sequence: Synthetic oligonucleotide
  modified_base (20)..(21): a, c, g, u, unknown or other
ccacccuuuuaagauaaaann

SEQ ID NO: 3122 - RNA, 21 nt, Artificial Sequence
  Description of Artificial Sequence: Synthetic oligonucleotide
  modified_base (20)..(21): a, c, g, u, unknown or other
accacccuuuuaagauaaann

SEQ ID NO: 3123 - RNA, 21 nt, Artificial Sequence
  Description of Artificial Sequence: Synthetic oligonucleotide
  modified_base (20)..(21): a, c, g, u, unknown or other
augagcggcagggccuggcnn

SEQ ID NO: 3124 - RNA, 21 nt, Artificial Sequence
  Description of Artificial Sequence: Synthetic oligonucleotide
  modified_base (20)..(21): a, c, g, u, unknown or other
uaccacccuuuuaagauaann

SEQ ID NO: 3125 - RNA, 21 nt, Artificial Sequence
  Description of Artificial Sequence: Synthetic oligonucleotide
  modified_base (20)..(21): a, c, g, u, unknown or other
cuaccacccuuuuaagauann

SEQ ID NO: 3126 - RNA, 21 nt, Artificial Sequence
  Description of Artificial Sequence: Synthetic oligonucleotide
  modified_base (20)..(21): a, c, g, u, unknown or other
acuaccacccuuuuaagaunn

SEQ ID NO: 3127 - RNA, 21 nt, Artificial Sequence
  Description of Artificial Sequence: Synthetic oligonucleotide
  modified_base (20)..(21): a, c, g, u, unknown or other
aacuaccacccuuuuaagann

SEQ ID NO: 3128 - RNA, 21 nt, Artificial Sequence
  Description of Artificial Sequence: Synthetic oligonucleotide
  modified_base (20)..(21): a, c, g, u, unknown or other
aaacuaccacccuuuuaagnn

SEQ ID NO: 3129 - RNA, 21 nt, Artificial Sequence
  Description of Artificial Sequence: Synthetic oligonucleotide
  modified_base (20)..(21): a, c, g, u, unknown or other
caugagcggcagggccuggnn

SEQ ID NO: 3130 - RNA, 21 nt, Artificial Sequence
  Description of Artificial Sequence: Synthetic oligonucleotide
  modified_base (20)..(21): a, c, g, u, unknown or other
ccaugagcggcagggccugnn

SEQ ID NO: 3131 - RNA, 21 nt, Artificial Sequence
  Description of Artificial Sequence: Synthetic oligonucleotide
  modified_base (20)..(21): a, c, g, u, unknown or other
cauaauaaguauuuuagggnn

SEQ ID NO: 3132 - RNA, 21 nt, Artificial Sequence
  Description of Artificial Sequence: Synthetic oligonucleotide
  modified_base (20)..(21): a, c, g, u, unknown or other
acauaauaaguauuuuaggnn

SEQ ID NO: 3133 - RNA, 21 nt, Artificial Sequence
  Description of Artificial Sequence: Synthetic oligonucleotide
  modified_base (20)..(21): a, c, g, u, unknown or other
uacauaauaaguauuuuagnn

SEQ ID NO: 3134 - RNA, 21 nt, Artificial Sequence
  Description of Artificial Sequence: Synthetic oligonucleotide
  modified_base (20)..(21): a, c, g, u, unknown or other
uuacauaauaaguauuuuann

SEQ ID NO: 3135 - RNA, 21 nt, Artificial Sequence
  Description of Artificial Sequence: Synthetic oligonucleotide
  modified_base (20)..(21): a, c, g, u, unknown or other
cuuacauaauaaguauuuunn

SEQ ID NO: 3136 - RNA, 21 nt, Artificial Sequence
  Description of Artificial Sequence: Synthetic oligonucleotide
  modified_base (20)..(21): a, c, g, u, unknown or other
ccuuacauaauaaguauuunn

SEQ ID NO: 3137 - RNA, 21 nt, Artificial Sequence
  Description of Artificial Sequence: Synthetic oligonucleotide
  modified_base (20)..(21): a, c, g, u, unknown or other
accaugagcggcagggccunn

SEQ ID NO: 3138 - RNA, 21 nt, Artificial Sequence
  Description of Artificial Sequence: Synthetic oligonucleotide
  modified_base (20)..(21): a, c, g, u, unknown or other
cccuuacauaauaaguauunn

SEQ ID NO: 3139 - RNA, 21 nt, Artificial Sequence
  Description of Artificial Sequence: Synthetic oligonucleotide
  modified_base (20)..(21): a, c, g, u, unknown or other
acccuuacauaauaaguaunn

SEQ ID NO: 3140 - RNA, 21 nt, Artificial Sequence
  Description of Artificial Sequence: Synthetic oligonucleotide
  modified_base (20)..(21): a, c, g, u, unknown or other
gacccuuacauaauaaguann

SEQ ID NO: 3141 - RNA, 21 nt, Artificial Sequence
  Description of Artificial Sequence: Synthetic oligonucleotide
  modified_base (20)..(21): a, c, g, u, unknown or other
ugacccuuacauaauaagunn

SEQ ID NO: 3142 - RNA, 21 nt, Artificial Sequence
  Description of Artificial Sequence: Synthetic oligonucleotide
  modified_base (20)..(21): a, c, g, u, unknown or other
augacccuuacauaauaagnn

SEQ ID NO: 3143 - RNA, 21 nt, Artificial Sequence
  Description of Artificial Sequence: Synthetic oligonucleotide
  modified_base (20)..(21): a, c, g, u, unknown or other
aaugacccuuacauaauaann

SEQ ID NO: 3144 - RNA, 21 nt, Artificial Sequence
  Description of Artificial Sequence: Synthetic oligonucleotide
  modified_base (20)..(21): a, c, g, u, unknown or other
uaaugacccuuacauaauann

SEQ ID NO: 3145 - RNA, 21 nt, Artificial Sequence
  Description of Artificial Sequence: Synthetic oligonucleotide
  modified_base (20)..(21): a, c, g, u, unknown or other
cuaaugacccuuacauaaunn

SEQ ID NO: 3146 - RNA, 21 nt, Artificial Sequence
  Description of Artificial Sequence: Synthetic oligonucleotide
  modified_base (20)..(21): a, c, g, u, unknown or other
ucuaaugacccuuacauaann

SEQ ID NO: 3147 - RNA, 21 nt, Artificial Sequence
  Description of Artificial Sequence: Synthetic oligonucleotide
  modified_base (20)..(21): a, c, g, u, unknown or other
gucuaaugacccuuacauann

SEQ ID NO: 3148 - RNA, 21 nt, Artificial Sequence
  Description of Artificial Sequence: Synthetic oligonucleotide
  modified_base (20)..(21): a, c, g, u, unknown or other
caccaugagcggcagggccnn

SEQ ID NO: 3149 - RNA, 21 nt, Artificial Sequence
  Description of Artificial Sequence: Synthetic oligonucleotide
  modified_base (20)..(21): a, c, g, u, unknown or other
ugucuaaugacccuuacaunn

SEQ ID NO: 3150 - RNA, 21 nt, Artificial Sequence
  Description of Artificial Sequence: Synthetic oligonucleotide
  modified_base (20)..(21): a, c, g, u, unknown or other
uugucuaaugacccuuacann

SEQ ID NO: 3151 - RNA, 21 nt, Artificial Sequence
  Description of Artificial Sequence: Synthetic oligonucleotide
  modified_base (20)..(21): a, c, g, u, unknown or other
uuugucuaaugacccuuacnn

SEQ ID NO: 3152 - RNA, 21 nt, Artificial Sequence
  Description of Artificial Sequence: Synthetic oligonucleotide
  modified_base (20)..(21): a, c, g, u, unknown or other
auuugucuaaugacccuuann

SEQ ID NO: 3153 - RNA, 21 nt, Artificial Sequence
  Description of Artificial Sequence: Synthetic oligonucleotide
  modified_base (20)..(21): a, c, g, u, unknown or other
cauuugucuaaugacccuunn

SEQ ID NO: 3154 - RNA, 21 nt, Artificial Sequence
  Description of Artificial Sequence: Synthetic oligonucleotide
  modified_base (20)..(21): a, c, g, u, unknown or other
acauuugucuaaugacccunn

SEQ ID NO: 3155 - RNA, 21 nt, Artificial Sequence
  Description of Artificial Sequence: Synthetic oligonucleotide
  modified_base (20)..(21): a, c, g, u, unknown or other
gacauuugucuaaugacccnn

SEQ ID NO: 3156 - RNA, 21 nt, Artificial Sequence
  Description of Artificial Sequence: Synthetic oligonucleotide
  modified_base (20)..(21): a, c, g, u, unknown or other
agacauuugucuaaugaccnn

SEQ ID NO: 3157 - RNA, 21 nt, Artificial Sequence
  Description of Artificial Sequence: Synthetic oligonucleotide
  modified_base (20)..(21): a, c, g, u, unknown or other
aagacauuugucuaaugacnn

SEQ ID NO: 3158 - RNA, 21 nt, Artificial Sequence
  Description of Artificial Sequence: Synthetic oligonucleotide
  modified_base (20)..(21): a, c, g, u, unknown or other
caagacauuugucuaaugann

SEQ ID NO: 3159 - RNA, 21 nt, Artificial Sequence
  Description of Artificial Sequence: Synthetic oligonucleotide
  modified_base (20)..(21): a, c, g, u, unknown or other
gcaccaugagcggcagggcnn

SEQ ID NO: 3160 - RNA, 21 nt, Artificial Sequence
  Description of Artificial Sequence: Synthetic oligonucleotide
  modified_base (20)..(21): a, c, g, u, unknown or other
ucaagacauuugucuaaugnn

SEQ ID NO: 3161 - RNA, 21 nt, Artificial Sequence
  Description of Artificial Sequence: Synthetic oligonucleotide
  modified_base (20)..(21): a, c, g, u, unknown or other
uucaagacauuugucuaaunn

SEQ ID NO: 3162 - RNA, 21 nt, Artificial Sequence
  Description of Artificial Sequence: Synthetic oligonucleotide
  modified_base (20)..(21): a, c, g, u, unknown or other
cuucaagacauuugucuaann

SEQ ID NO: 3163 - RNA, 21 nt, Artificial Sequence
  Description of Artificial Sequence: Synthetic oligonucleotide
  modified_base (20)..(21): a, c, g, u, unknown or other
acuucaagacauuugucuann

SEQ ID NO: 3164 - RNA, 21 nt, Artificial Sequence
  Description of Artificial Sequence: Synthetic oligonucleotide
  modified_base (20)..(21): a, c, g, u, unknown or other
uacuucaagacauuugucunn

SEQ ID NO: 3165 - RNA, 21 nt, Artificial Sequence
  Description of Artificial Sequence: Synthetic oligonucleotide
  modified_base (20)..(21): a, c, g, u, unknown or other
cuacuucaagacauuugucnn

SEQ ID NO: 3166 - RNA, 21 nt, Artificial Sequence
  Description of Artificial Sequence: Synthetic oligonucleotide
  modified_base (20)..(21): a, c, g, u, unknown or other
ucuacuucaagacauuugunn

SEQ ID NO: 3167 - RNA, 21 nt, Artificial Sequence
  Description of Artificial Sequence: Synthetic oligonucleotide
  modified_base (20)..(21): a, c, g, u, unknown or other
ggcaccaugagcggcagggnn

SEQ ID NO: 3168 - RNA, 21 nt, Artificial Sequence
  Description of Artificial Sequence: Synthetic oligonucleotide
  modified_base (20)..(21): a, c, g, u, unknown or other
uggcaccaugagcggcaggnn

SEQ ID NO: 3169 - RNA, 21 nt, Artificial Sequence
  Description of Artificial Sequence: Synthetic oligonucleotide
  modified_base (20)..(21): a, c, g, u, unknown or other
aagaaccauucauaaauucnn

SEQ ID NO: 3170 - RNA, 21 nt, Artificial Sequence
  Description of Artificial Sequence: Synthetic oligonucleotide
  modified_base (20)..(21): a, c, g, u, unknown or other
cuggcaccaugagcggcagnn

SEQ ID NO: 3171 - RNA, 21 nt, Artificial Sequence
  Description of Artificial Sequence: Synthetic oligonucleotide
  modified_base (20)..(21): a, c, g, u, unknown or other
aaagaaccauucauaaauunn

SEQ ID NO: 3172 - RNA, 21 nt, Artificial Sequence
  Description of Artificial Sequence: Synthetic oligonucleotide
  modified_base (20)..(21): a, c, g, u, unknown or other
uaaagaaccauucauaaaunn

SEQ ID NO: 3173 - RNA, 21 nt, Artificial Sequence
  Description of Artificial Sequence: Synthetic oligonucleotide
  modified_base (20)..(21): a, c, g, u, unknown or other
auaaagaaccauucauaaann

SEQ ID NO: 3174 - RNA, 21 nt, Artificial Sequence
  Description of Artificial Sequence: Synthetic oligonucleotide
  modified_base (20)..(21): a, c, g, u, unknown or other
gauaaagaaccauucauaann

SEQ ID NO: 3175 - RNA, 21 nt, Artificial Sequence
  Description of Artificial Sequence: Synthetic oligonucleotide
  modified_base (20)..(21): a, c, g, u, unknown or other
ugauaaagaaccauucauann

SEQ ID NO: 3176 - RNA, 21 nt, Artificial Sequence
  Description of Artificial Sequence: Synthetic oligonucleotide
  modified_base (20)..(21): a, c, g, u, unknown or other
augauaaagaaccauucaunn

SEQ ID NO: 3177 - RNA, 21 nt, Artificial Sequence
  Description of Artificial Sequence: Synthetic oligonucleotide
  modified_base (20)..(21): a, c, g, u, unknown or other
aaugauaaagaaccauucann

SEQ ID NO: 3178 - RNA, 21 nt, Artificial Sequence
  Description of Artificial Sequence: Synthetic oligonucleotide
  modified_base (20)..(21): a, c, g, u, unknown or other
aaaugauaaagaaccauucnn

SEQ ID NO: 3179 - RNA, 21 nt, Artificial Sequence
  Description of Artificial Sequence: Synthetic oligonucleotide
  modified_base (20)..(21): a, c, g, u, unknown or other
gaaaugauaaagaaccauunn

SEQ ID NO: 3180 - RNA, 21 nt, Artificial Sequence
  Description of Artificial Sequence: Synthetic oligonucleotide
  modified_base (20)..(21): a, c, g, u, unknown or other
agaaaugauaaagaaccaunn

SEQ ID NO: 3181 - RNA, 21 nt, Artificial Sequence
  Description of Artificial Sequence: Synthetic oligonucleotide
  modified_base (20)..(21): a, c, g, u, unknown or other
gcuggcaccaugagcggcann

SEQ ID NO: 3182 - RNA, 21 nt, Artificial Sequence
  Description of Artificial Sequence: Synthetic oligonucleotide
  modified_base (20)..(21): a, c, g, u, unknown or other
gagaaaugauaaagaaccann

SEQ ID NO: 3183 - RNA, 21 nt, Artificial Sequence
  Description of Artificial Sequence: Synthetic oligonucleotide
  modified_base (20)..(21): a, c, g, u, unknown or other
agagaaaugauaaagaaccnn

SEQ ID NO: 3184 - RNA, 21 nt, Artificial Sequence
  Description of Artificial Sequence: Synthetic oligonucleotide
  modified_base (20)..(21): a, c, g, u, unknown or other
aagagaaaugauaaagaacnn

SEQ ID NO: 3185 - RNA, 21 nt, Artificial Sequence
  Description of Artificial Sequence: Synthetic oligonucleotide
  modified_base (20)..(21): a, c, g, u, unknown or other
gaagagaaaugauaaagaann

SEQ ID NO: 3186 - RNA, 21 nt, Artificial Sequence
  Description of Artificial Sequence: Synthetic oligonucleotide
  modified_base (20)..(21): a, c, g, u, unknown or other
ggaagagaaaugauaaagann

SEQ ID NO: 3187 - RNA, 21 nt, Artificial Sequence
  Description of Artificial Sequence: Synthetic oligonucleotide
  modified_base (20)..(21): a, c, g, u, unknown or other
gggaagagaaaugauaaagnn

SEQ ID NO: 3188 - RNA, 21 nt, Artificial Sequence
  Description of Artificial Sequence: Synthetic oligonucleotide
  modified_base (20)..(21): a, c, g, u, unknown or other
ggggaagagaaaugauaaann

SEQ ID NO: 3189 - RNA, 21 nt, Artificial Sequence
  Description of Artificial Sequence: Synthetic oligonucleotide
  modified_base (20)..(21): a, c, g, u, unknown or other
gggggaagagaaaugauaann

SEQ ID NO: 3190 - RNA, 21 nt, Artificial Sequence
  Description of Artificial Sequence: Synthetic oligonucleotide
  modified_base (20)..(21): a, c, g, u, unknown or other
agggggaagagaaaugauann

SEQ ID NO: 3191 - RNA, 21 nt, Artificial Sequence
  Description of Artificial Sequence: Synthetic oligonucleotide
  modified_base (20)..(21): a, c, g, u, unknown or other
aagggggaagagaaaugaunn

SEQ ID NO: 3192 - RNA, 21 nt, Artificial Sequence
  Description of Artificial Sequence: Synthetic oligonucleotide
  modified_base (20)..(21): a, c, g, u, unknown or other
ggcuggcaccaugagcggcnn

SEQ ID NO: 3193 - RNA, 21 nt, Artificial Sequence
  Description of Artificial Sequence: Synthetic oligonucleotide
  modified_base (20)..(21): a, c, g, u, unknown or other
aaagggggaagagaaaugann

SEQ ID NO: 3194 - RNA, 21 nt, Artificial Sequence
  Description of Artificial Sequence: Synthetic oligonucleotide
  modified_base (20)..(21): a, c, g, u, unknown or other
aaaagggggaagagaaaugnn

SEQ ID NO: 3195 - RNA, 21 nt, Artificial Sequence
  Description of Artificial Sequence: Synthetic oligonucleotide
  modified_base (20)..(21): a, c, g, u, unknown or other
aaaaagggggaagagaaaunn

SEQ ID NO: 3196 - RNA, 21 nt, Artificial Sequence
  Description of Artificial Sequence: Synthetic oligonucleotide
  modified_base (20)..(21): a, c, g, u, unknown or other
caaaaagggggaagagaaann

SEQ ID NO: 3197 - RNA, 21 nt, Artificial Sequence
  Description of Artificial Sequence: Synthetic oligonucleotide
  modified_base (20)..(21): a, c, g, u, unknown or other
ccaaaaagggggaagagaann

SEQ ID NO: 3198 - RNA, 21 nt, Artificial Sequence
  Description of Artificial Sequence: Synthetic oligonucleotide
  modified_base (20)..(21): a, c, g, u, unknown or other
gccaaaaagggggaagagann

SEQ ID NO: 3199 - RNA, 21 nt, Artificial Sequence
  Description of Artificial Sequence: Synthetic oligonucleotide
  modified_base (20)..(21): a, c, g, u, unknown or other
ugccaaaaagggggaagagnn

SEQ ID NO: 3200 - RNA, 21 nt, Artificial Sequence
  Description of Artificial Sequence: Synthetic oligonucleotide
  modified_base (20)..(21): a, c, g, u, unknown or other
augccaaaaagggggaagann

SEQ ID NO: 3201 - RNA, 21 nt, Artificial Sequence
  Description of Artificial Sequence: Synthetic oligonucleotide
  modified_base (20)..(21): a, c, g, u, unknown or other
gaugccaaaaagggggaagnn

SEQ ID NO: 3202 - RNA, 21 nt, Artificial Sequence
  Description of Artificial Sequence: Synthetic oligonucleotide
  modified_base (20)..(21): a, c, g, u, unknown or other
ggaugccaaaaagggggaann

SEQ ID NO: 3203 - RNA, 21 nt, Artificial Sequence
  Description of Artificial Sequence: Synthetic oligonucleotide
  modified_base (20)..(21): a, c, g, u, unknown or other
gggcuggcaccaugagcggnn

SEQ ID NO: 3204 - RNA, 21 nt, Artificial Sequence
  Description of Artificial Sequence: Synthetic oligonucleotide
  modified_base (20)..(21): a, c, g, u, unknown or other
aggaugccaaaaagggggann

SEQ ID NO: 3205 - RNA, 21 nt, Artificial Sequence
  Description of Artificial Sequence: Synthetic oligonucleotide
  modified_base (20)..(21): a, c, g, u, unknown or other
caggaugccaaaaagggggnn

SEQ ID NO: 3206 - RNA, 21 nt, Artificial Sequence
  Description of Artificial Sequence: Synthetic oligonucleotide
  modified_base (20)..(21): a, c, g, u, unknown or other
ccaggaugccaaaaaggggnn

SEQ ID NO: 3207 - RNA, 21 nt, Artificial Sequence
  Description of Artificial Sequence: Synthetic oligonucleotide
  modified_base (20)..(21): a, c, g, u, unknown or other
gccaggaugccaaaaagggnn

SEQ ID NO: 3208 - RNA, 21 nt, Artificial Sequence
  Description of Artificial Sequence: Synthetic oligonucleotide
  modified_base (20)..(21): a, c, g, u, unknown or other
agccaggaugccaaaaaggnn

SEQ ID NO: 3209 - RNA, 21 nt, Artificial Sequence
  Description of Artificial Sequence: Synthetic oligonucleotide
  modified_base (20)..(21): a, c, g, u, unknown or other
aagccaggaugccaaaaagnn

SEQ ID NO: 3210 - RNA, 21 nt, Artificial Sequence
  Description of Artificial Sequence: Synthetic oligonucleotide
  modified_base (20)..(21): a, c, g, u, unknown or other
caagccaggaugccaaaaann

SEQ ID NO: 3211 - RNA, 21 nt, Artificial Sequence
  Description of Artificial Sequence: Synthetic oligonucleotide
  modified_base (20)..(21): a, c, g, u, unknown or other
gcaagccaggaugccaaaann

SEQ ID NO: 3212 - RNA, 21 nt, Artificial Sequence
  Description of Artificial Sequence: Synthetic oligonucleotide
  modified_base (20)..(21): a, c, g, u, unknown or other
ggcaagccaggaugccaaann

SEQ ID NO: 3213 - RNA, 21 nt, Artificial Sequence
  Description of Artificial Sequence: Synthetic oligonucleotide
  modified_base (20)..(21): a, c, g, u, unknown or other
aggcaagccaggaugccaann

SEQ ID NO: 3214 - RNA, 21 nt, Artificial Sequence
  Description of Artificial Sequence: Synthetic oligonucleotide
  modified_base (20)..(21): a, c, g, u, unknown or other
ugggcuggcaccaugagcgnn

SEQ ID NO: 3215 - RNA, 21 nt, Artificial Sequence
  Description of Artificial Sequence: Synthetic oligonucleotide
  modified_base (20)..(21): a, c, g, u, unknown or other
gaggcaagccaggaugccann

SEQ ID NO: 3216 - RNA, 21 nt, Artificial Sequence
  Description of Artificial Sequence: Synthetic oligonucleotide
  modified_base (20)..(21): a, c, g, u, unknown or other
ggaggcaagccaggaugccnn

SEQ ID NO: 3217 - RNA, 21 nt, Artificial Sequence
  Description of Artificial Sequence: Synthetic oligonucleotide
  modified_base (20)..(21): a, c, g, u, unknown or other
uggaggcaagccaggaugcnn

SEQ ID NO: 3218 - RNA, 21 nt, Artificial Sequence
  Description of Artificial Sequence: Synthetic oligonucleotide
  modified_base (20)..(21): a, c, g, u, unknown or other
cuggaggcaagccaggaugnn

SEQ ID NO: 3219 - RNA, 21 nt, Artificial Sequence
  Description of Artificial Sequence: Synthetic oligonucleotide
  modified_base (20)..(21): a, c, g, u, unknown or other
acuggaggcaagccaggaunn

SEQ ID NO: 3220 - RNA, 21 nt, Artificial Sequence
  Description of Artificial Sequence: Synthetic oligonucleotide
  modified_base (20)..(21): a, c, g, u, unknown or other
aacuggaggcaagccaggann

SEQ ID NO: 3221 - RNA, 21 nt, Artificial Sequence
  Description of Artificial Sequence: Synthetic oligonucleotide
  modified_base (20)..(21): a, c, g, u, unknown or other
aaacuggaggcaagccaggnn

SEQ ID NO: 3222 - RNA, 21 nt, Artificial Sequence
  Description of Artificial Sequence: Synthetic oligonucleotide
  modified_base (20)..(21): a, c, g, u, unknown or other
aaaacuggaggcaagccagnn

SEQ ID NO: 3223 - RNA, 21 nt, Artificial Sequence
  Description of Artificial Sequence: Synthetic oligonucleotide
  modified_base (20)..(21): a, c, g, u, unknown or other
uaaaacuggaggcaagccann

SEQ ID NO: 3224 - RNA, 21 nt, Artificial Sequence
  Description of Artificial Sequence: Synthetic oligonucleotide
  modified_base (20)..(21): a, c, g, u, unknown or other
cuaaaacuggaggcaagccnn

SEQ ID NO: 3225 - RNA, 21 nt, Artificial Sequence
  Description of Artificial Sequence: Synthetic oligonucleotide
  modified_base (20)..(21): a, c, g, u, unknown or other
cugggcuggcaccaugagcnn

SEQ ID NO: 3226 - RNA, 21 nt, Artificial Sequence
  Description of Artificial Sequence: Synthetic oligonucleotide
  modified_base (20)..(21): a, c, g, u, unknown or other
ccuaaaacuggaggcaagcnn

SEQ ID NO: 3227 - RNA, 21 nt, Artificial Sequence
  Description of Artificial Sequence: Synthetic oligonucleotide
  modified_base (20)..(21): a, c, g, u, unknown or other
accuaaaacuggaggcaagnn

SEQ ID NO: 3228 - RNA, 21 nt, Artificial Sequence
  Description of Artificial Sequence: Synthetic oligonucleotide
  modified_base (20)..(21): a, c, g, u, unknown or other
gaccuaaaacuggaggcaann

SEQ ID NO: 3229 - RNA, 21 nt, Artificial Sequence
  Description of Artificial Sequence: Synthetic oligonucleotide
  modified_base (20)..(21): a, c, g, u, unknown or other
ggaccuaaaacuggaggcann

SEQ ID NO: 3230 - RNA, 21 nt, Artificial Sequence
  Description of Artificial Sequence: Synthetic oligonucleotide
  modified_base (20)..(21): a, c, g, u, unknown or other
ucugggcuggcaccaugagnn

SEQ ID NO: 3231 - RNA, 21 nt, Artificial Sequence
  Description of Artificial Sequence: Synthetic oligonucleotide
  modified_base (20)..(21): a, c, g, u, unknown or other
cucugggcuggcaccaugann

SEQ ID NO: 3232 - RNA, 21 nt, Artificial Sequence
  Description of Artificial Sequence: Synthetic oligonucleotide
  modified_base (20)..(21): a, c, g, u, unknown or other
gcuuacagaagcaaacuaann

SEQ ID NO: 3233 - RNA, 21 nt, Artificial Sequence
  Description of Artificial Sequence: Synthetic oligonucleotide
  modified_base (20)..(21): a, c, g, u, unknown or other
ugcuuacagaagcaaacuann

SEQ ID NO: 3234 - RNA, 21 nt, Artificial Sequence
  Description of Artificial Sequence: Synthetic oligonucleotide
  modified_base (20)..(21): a, c, g, u, unknown or other
uugcuuacagaagcaaacunn

SEQ ID NO: 3235 - RNA, 21 nt, Artificial Sequence
  Description of Artificial Sequence: Synthetic oligonucleotide
  modified_base (20)..(21): a, c, g, u, unknown or other
ucucugggcuggcaccaugnn

SEQ ID NO: 3236 - RNA, 21 nt, Artificial Sequence
  Description of Artificial Sequence: Synthetic oligonucleotide
  modified_base (20)..(21): a, c, g, u, unknown or other
cucucugggcuggcaccaunn

SEQ ID NO: 3237 - RNA, 21 nt, Artificial Sequence
  Description of Artificial Sequence: Synthetic oligonucleotide
  modified_base (20)..(21): a, c, g, u, unknown or other
gcccccucagcagguguucnn

SEQ ID NO: 3238 - RNA, 21 nt, Artificial Sequence
  Description of Artificial Sequence: Synthetic oligonucleotide
  modified_base (20)..(21): a, c, g, u, unknown or other
agcccccucagcagguguunn

SEQ ID NO: 3239 - RNA, 21 nt, Artificial Sequence
  Description of Artificial Sequence: Synthetic oligonucleotide
  modified_base (20)..(21): a, c, g, u, unknown or other
gagcccccucagcaggugunn

SEQ ID NO: 3240 - RNA, 21 nt, Artificial Sequence
  Description of Artificial Sequence: Synthetic oligonucleotide
  modified_base (20)..(21): a, c, g, u, unknown or other
ccucucugggcuggcaccann

SEQ ID NO: 3241 - RNA, 21 nt, Artificial Sequence
  Description of Artificial Sequence: Synthetic oligonucleotide
  modified_base (20)..(21): a, c, g, u, unknown or other
agagcccccucagcaggugnn

SEQ ID NO: 3242 - RNA, 21 nt, Artificial Sequence
  Description of Artificial Sequence: Synthetic oligonucleotide
  modified_base (20)..(21): a, c, g, u, unknown or other
aagagcccccucagcaggunn

SEQ ID NO: 3243 - RNA, 21 nt, Artificial Sequence
  Description of Artificial Sequence: Synthetic oligonucleotide
  modified_base (20)..(21): a, c, g, u, unknown or other
aaagagcccccucagcaggnn

SEQ ID NO: 3244 - RNA, 21 nt, Artificial Sequence
  Description of Artificial Sequence: Synthetic oligonucleotide
  modified_base (20)..(21): a, c, g, u, unknown or other
gaaagagcccccucagcagnn

SEQ ID NO: 3245 - RNA, 21 nt, Artificial Sequence
  Description of Artificial Sequence: Synthetic oligonucleotide
  modified_base (20)..(21): a, c, g, u, unknown or other
ggaaagagcccccucagcann

SEQ ID NO: 3246 - RNA, 21 nt, Artificial Sequence
  Description of Artificial Sequence: Synthetic oligonucleotide
  modified_base (20)..(21): a, c, g, u, unknown or other
gggaaagagcccccucagcnn

SEQ ID NO: 3247 - RNA, 21 nt, Artificial Sequence
  Description of Artificial Sequence: Synthetic oligonucleotide
  modified_base (20)..(21): a, c, g, u, unknown or other
agggaaagagcccccucagnn

SEQ ID NO: 3248 - RNA, 21 nt, Artificial Sequence
  Description of Artificial Sequence: Synthetic oligonucleotide
  modified_base (20)..(21): a, c, g, u, unknown or other
gagggaaagagcccccucann

SEQ ID NO: 3249 - RNA, 21 nt, Artificial Sequence
  Description of Artificial Sequence: Synthetic oligonucleotide
  modified_base (20)..(21): a, c, g, u, unknown or other
ugagggaaagagcccccucnn

SEQ ID NO: 3250 - RNA, 21 nt, Artificial Sequence
  Description of Artificial Sequence: Synthetic oligonucleotide
  modified_base (20)..(21): a, c, g, u, unknown or other
cccucucugggcuggcaccnn

SEQ ID NO: 3251 - RNA, 21 nt, Artificial Sequence
  Description of Artificial Sequence: Synthetic oligonucleotide
  modified_base (20)..(21): a, c, g, u, unknown or other
ccccucucugggcuggcacnn

SEQ ID NO: 3252 - RNA, 21 nt, Artificial Sequence
  Description of Artificial Sequence: Synthetic oligonucleotide
  modified_base (20)..(21): a, c, g, u, unknown or other
gaucuuacuugaaguauacnn

SEQ ID NO: 3253 - RNA, 21 nt, Artificial Sequence
  Description of Artificial Sequence: Synthetic oligonucleotide
  modified_base (20)..(21): a, c, g, u, unknown or other
ugaucuuacuugaaguauann

SEQ ID NO: 3254 - RNA, 21 nt, Artificial Sequence
  Description of Artificial Sequence: Synthetic oligonucleotide
  modified_base (20)..(21): a, c, g, u, unknown or other
gccccucucugggcuggcann

SEQ ID NO: 3255 - RNA, 21 nt, Artificial Sequence
  Description of Artificial Sequence: Synthetic oligonucleotide
  modified_base (20)..(21): a, c, g, u, unknown or other
uugaucuuacuugaaguaunn

SEQ ID NO: 3256 - RNA, 21 nt, Artificial Sequence
  Description of Artificial Sequence: Synthetic oligonucleotide
  modified_base (20)..(21): a, c, g, u, unknown or other
cuugaucuuacuugaaguann

SEQ ID NO: 3257 - RNA, 21 nt, Artificial Sequence
  Description of Artificial Sequence: Synthetic oligonucleotide
  modified_base (20)..(21): a, c, g, u, unknown or other
ucuugaucuuacuugaagunn

SEQ ID NO: 3258 - RNA, 21 nt, Artificial Sequence
  Description of Artificial Sequence: Synthetic oligonucleotide
  modified_base (20)..(21): a, c, g, u, unknown or other
uucuugaucuuacuugaagnn

SEQ ID NO: 3259 - RNA, 21 nt, Artificial Sequence
  Description of Artificial Sequence: Synthetic oligonucleotide
  modified_base (20)..(21): a, c, g, u, unknown or other
auucuugaucuuacuugaann

SEQ ID NO: 3260 - RNA, 21 nt, Artificial Sequence
  Description of Artificial Sequence: Synthetic oligonucleotide
  modified_base (20)..(21): a, c, g, u, unknown or other
gauucuugaucuuacuugann

SEQ ID NO: 3261 - RNA, 21 nt, Artificial Sequence
  Description of Artificial Sequence: Synthetic oligonucleotide
  modified_base (20)..(21): a, c, g, u, unknown or other
agauucuugaucuuacuugnn

SEQ ID NO: 3262 - RNA, 21 nt, Artificial Sequence
  Description of Artificial Sequence: Synthetic oligonucleotide
  modified_base (20)..(21): a, c, g, u, unknown or other
aagauucuugaucuuacuunn

SEQ ID NO: 3263 - RNA, 21 nt, Artificial Sequence
  Description of Artificial Sequence: Synthetic oligonucleotide
  modified_base (20)..(21): a, c, g, u, unknown or other
aaagauucuugaucuuacunn

SEQ ID NO: 3264 - RNA, 21 nt, Artificial Sequence
  Description of Artificial Sequence: Synthetic oligonucleotide
  modified_base (20)..(21): a, c, g, u, unknown or other
aaaagauucuugaucuuacnn

SEQ ID NO: 3265 - RNA, 21 nt, Artificial Sequence
  Description of Artificial Sequence: Synthetic oligonucleotide
  modified_base (20)..(21): a, c, g, u, unknown or other
caaaagauucuugaucuuann

SEQ ID NO: 3266 - RNA, 21 nt, Artificial Sequence
  Description of Artificial Sequence: Synthetic oligonucleotide
  modified_base (20)..(21): a, c, g, u, unknown or other
acaaaagauucuugaucuunn

SEQ ID NO: 3267 - RNA, 21 nt, Artificial Sequence
  Description of Artificial Sequence: Synthetic oligonucleotide
  modified_base (20)..(21): a, c, g, u, unknown or other
cacaaaagauucuugaucunn

SEQ ID NO: 3268 - RNA, 21 nt, Artificial Sequence
  Description of Artificial Sequence: Synthetic oligonucleotide
  modified_base (20)..(21): a, c, g, u, unknown or other
ucacaaaagauucuugaucnn

SEQ ID NO: 3269 - RNA, 21 nt, Artificial Sequence
  Description of Artificial Sequence: Synthetic oligonucleotide
  modified_base (20)..(21): a, c, g, u, unknown or other
uucacaaaagauucuugaunn

SEQ ID NO: 3270 - RNA, 21 nt, Artificial Sequence
  Description of Artificial Sequence: Synthetic oligonucleotide
  modified_base (20)..(21): a, c, g, u, unknown or other
uuucacaaaagauucuugann

SEQ ID NO: 3271 - RNA, 21 nt, Artificial Sequence
  Description of Artificial Sequence: Synthetic oligonucleotide
  modified_base (20)..(21): a, c, g, u, unknown or other
uacauaguaaauuucuauann

SEQ ID NO: 3272 - RNA, 21 nt, Artificial Sequence
  Description of Artificial Sequence: Synthetic oligonucleotide
  modified_base (20)..(21): a, c, g, u, unknown or other
uuacauaguaaauuucuaunn

SEQ ID NO: 3273 - RNA, 21 nt, Artificial Sequence
  Description of Artificial Sequence: Synthetic oligonucleotide
  modified_base (20)..(21): a, c, g, u, unknown or other
uuuacauaguaaauuucuann

SEQ ID NO: 3274 - RNA, 21 nt, Artificial Sequence
  Description of Artificial Sequence: Synthetic oligonucleotide
  modified_base (20)..(21): a, c, g, u, unknown or other
auuuacauaguaaauuucunn

SEQ ID NO: 3275 - RNA, 21 nt, Artificial Sequence
  Description of Artificial Sequence: Synthetic oligonucleotide
  modified_base (20)..(21): a, c, g, u, unknown or other
cauuuacauaguaaauuucnn

SEQ ID NO: 3276 - RNA, 21 nt, Artificial Sequence
  Description of Artificial Sequence: Synthetic oligonucleotide
  modified_base (20)..(21): a, c, g, u, unknown or other
gcauuuacauaguaaauuunn

SEQ ID NO: 3277 - RNA, 21 nt, Artificial Sequence
  Description of Artificial Sequence: Synthetic oligonucleotide
  modified_base (20)..(21): a, c, g, u, unknown or other
agcauuuacauaguaaauunn

SEQ ID NO: 3278 - RNA, 21 nt, Artificial Sequence
  Description of Artificial Sequence: Synthetic oligonucleotide
  modified_base (20)..(21): a, c, g, u, unknown or other
aagcauuuacauaguaaaunn

SEQ ID NO: 3279 - RNA, 21 nt, Artificial Sequence
  Description of Artificial Sequence: Synthetic oligonucleotide
  modified_base (20)..(21): a, c, g, u, unknown or other
caagcauuuacauaguaaann

SEQ ID NO: 3280 - RNA, 21 nt, Artificial Sequence
  Description of Artificial Sequence: Synthetic oligonucleotide
  modified_base (20)..(21): a, c, g, u, unknown or other
ucaagcauuuacauaguaann

SEQ ID NO: 3281 - RNA, 21 nt, Artificial Sequence
  Description of Artificial Sequence: Synthetic oligonucleotide
  modified_base (20)..(21): a, c, g, u, unknown or other
aucaagcauuuacauaguann

SEQ ID NO: 3282 - RNA, 21 nt, Artificial Sequence
  Description of Artificial Sequence: Synthetic oligonucleotide
  modified_base (20)..(21): a, c, g, u, unknown or other
caucaagcauuuacauagunn

SEQ ID NO: 3283 - RNA, 21 nt, Artificial Sequence
  Description of Artificial Sequence: Synthetic oligonucleotide
  modified_base (20)..(21): a, c, g, u, unknown or other
ccaucaagcauuuacauagnn

SEQ ID NO: 3284 - RNA, 21 nt, Artificial Sequence
  Description of Artificial Sequence: Synthetic oligonucleotide
  modified_base (20)..(21): a, c, g, u, unknown or other
uccaucaagcauuuacauann

SEQ ID NO: 3285 - RNA, 21 nt, Artificial Sequence
  Description of Artificial Sequence: Synthetic oligonucleotide
  modified_base (20)..(21): a, c, g, u, unknown or other
uuccaucaagcauuuacaunn

SEQ ID NO: 3286 - RNA, 21 nt, Artificial Sequence
  Description of Artificial Sequence: Synthetic oligonucleotide
  modified_base (20)..(21): a, c, g, u, unknown or other
auuccaucaagcauuuacann

SEQ ID NO: 3287 - RNA, 21 nt, Artificial Sequence
  Description of Artificial Sequence: Synthetic oligonucleotide
  modified_base (20)..(21): a, c, g, u, unknown or other
aauuccaucaagcauuuacnn

SEQ ID NO: 3288 - RNA, 21 nt, Artificial Sequence
  Description of Artificial Sequence: Synthetic oligonucleotide
  modified_base (20)..(21): a, c, g, u, unknown or other
aaauuccaucaagcauuuann

SEQ ID NO: 3289 - RNA, 21 nt, Artificial Sequence
  Description of Artificial Sequence: Synthetic oligonucleotide
  modified_base (20)..(21): a, c, g, u, unknown or other
aaaauuccaucaagcauuunn

SEQ ID NO: 3290 - RNA, 21 nt, Artificial Sequence
  Description of Artificial Sequence: Synthetic oligonucleotide
  modified_base (20)..(21): a, c, g, u, unknown or other
aaaaauuccaucaagcauunn

SEQ ID NO: 3291 - RNA, 21 nt, Artificial Sequence
  Description of Artificial Sequence: Synthetic oligonucleotide
  modified_base (20)..(21): a, c, g, u, unknown or other
aaaaaauuccaucaagcaunn

SEQ ID NO: 3292 - RNA, 21 nt, Artificial Sequence
  Description of Artificial Sequence: Synthetic oligonucleotide
  modified_base (20)..(21): a, c, g, u, unknown or other
gaaaaaauuccaucaagcann

SEQ ID NO: 3293 - RNA, 21 nt, Artificial Sequence
  Description of Artificial Sequence: Synthetic oligonucleotide
  modified_base (20)..(21): a, c, g, u, unknown or other
ggaaaaaauuccaucaagcnn

SEQ ID NO: 3294 - RNA, 21 nt, Artificial Sequence
  Description of Artificial Sequence: Synthetic oligonucleotide
  modified_base (20)..(21): a, c, g, u, unknown or other
aggaaaaaauuccaucaagnn

SEQ ID NO: 3295 - RNA, 21 nt, Artificial Sequence
  Description of Artificial Sequence: Synthetic oligonucleotide
  modified_base (20)..(21): a, c, g, u, unknown or other
caggaaaaaauuccaucaann

SEQ ID NO: 3296 - RNA, 21 nt, Artificial Sequence
  Description of Artificial Sequence: Synthetic oligonucleotide
  modified_base (20)..(21): a, c, g, u, unknown or other
gcaggaaaaaauuccaucann

SEQ ID NO: 3297 - RNA, 21 nt, Artificial Sequence
  Description of Artificial Sequence: Synthetic oligonucleotide
  modified_base (20)..(21): a, c, g, u, unknown or other
agcaggaaaaaauuccaucnn

SEQ ID NO: 3298 - RNA, 21 nt, Artificial Sequence
  Description of Artificial Sequence: Synthetic oligonucleotide
  modified_base (20)..(21): a, c, g, u, unknown or other
uagcaggaaaaaauuccaunn

SEQ ID NO: 3299 - RNA, 21 nt, Artificial Sequence
  Description of Artificial Sequence: Synthetic oligonucleotide
  modified_base (20)..(21): a, c, g, u, unknown or other
cuagcaggaaaaaauuccann

SEQ ID NO: 3300 - RNA, 21 nt, Artificial Sequence
  Description of Artificial Sequence: Synthetic oligonucleotide
  modified_base (20)..(21): a, c, g, u, unknown or other
acuagcaggaaaaaauuccnn

SEQ ID NO: 3301 - RNA, 21 nt, Artificial Sequence
  Description of Artificial Sequence: Synthetic oligonucleotide
  modified_base (20)..(21): a, c, g, u, unknown or other
cacuagcaggaaaaaauucnn

SEQ ID NO: 3302 - RNA, 21 nt, Artificial Sequence
  Description of Artificial Sequence: Synthetic oligonucleotide
  modified_base (20)..(21): a, c, g, u, unknown or other
acacuagcaggaaaaaauunn

SEQ ID NO: 3303 - RNA, 21 nt, Artificial Sequence
  Description of Artificial Sequence: Synthetic oligonucleotide
  modified_base (20)..(21): a, c, g, u, unknown or other
uacacuagcaggaaaaaaunn

SEQ ID NO: 3304 - RNA, 21 nt, Artificial Sequence
  Description of Artificial Sequence: Synthetic oligonucleotide
  modified_base (20)..(21): a, c, g, u, unknown or other
cuacacuagcaggaaaaaann

SEQ ID NO: 3305 - RNA, 21 nt, Artificial Sequence
  Description of Artificial Sequence: Synthetic oligonucleotide
  modified_base (20)..(21): a, c, g, u, unknown or other
gcuacacuagcaggaaaaann

SEQ ID NO: 3306 - RNA, 21 nt, Artificial Sequence
  Description of Artificial Sequence: Synthetic oligonucleotide
  modified_base (20)..(21): a, c, g, u, unknown or other
agcuacacuagcaggaaaann

SEQ ID NO: 3307 - RNA, 21 nt, Artificial Sequence
  Description of Artificial Sequence: Synthetic oligonucleotide
  modified_base (20)..(21): a, c, g, u, unknown or other
aagcuacacuagcaggaaann

SEQ ID NO: 3308 - RNA, 21 nt, Artificial Sequence
  Description of Artificial Sequence: Synthetic oligonucleotide
  modified_base (20)..(21): a, c, g, u, unknown or other
gaagcuacacuagcaggaann

SEQ ID NO: 3309 - RNA, 21 nt, Artificial Sequence
  Description of Artificial Sequence: Synthetic oligonucleotide
  modified_base (20)..(21): a, c, g, u, unknown or other
agaagcuacacuagcaggann

SEQ ID NO: 3310 - RNA, 21 nt, Artificial Sequence
  Description of Artificial Sequence: Synthetic oligonucleotide
  modified_base (20)..(21): a, c, g, u, unknown or other
cagaagcuacacuagcaggnn

SEQ ID NO: 3311 - RNA, 21 nt, Artificial Sequence
  Description of Artificial Sequence: Synthetic oligonucleotide
  modified_base (20)..(21): a, c, g, u, unknown or other
ucagaagcuacacuagcagnn

SEQ ID NO: 3312 - RNA, 21 nt, Artificial Sequence
  Description of Artificial Sequence: Synthetic oligonucleotide
  modified_base (20)..(21): a, c, g, u, unknown or other
uucagaagcuacacuagcann

SEQ ID NO: 3313 - RNA, 21 nt, Artificial Sequence
  Description of Artificial Sequence: Synthetic oligonucleotide
  modified_base (20)..(21): a, c, g, u, unknown or other
uuucagaagcuacacuagcnn

SEQ ID NO: 3314 - RNA, 21 nt, Artificial Sequence
  Description of Artificial Sequence: Synthetic oligonucleotide
  modified_base (20)..(21): a, c, g, u, unknown or other
cuuucagaagcuacacuagnn

SEQ ID NO: 3315 - RNA, 21 nt, Artificial Sequence
  Description of Artificial Sequence: Synthetic oligonucleotide
  modified_base (20)..(21): a, c, g, u, unknown or other
ccuuucagaagcuacacuann

SEQ ID NO: 3316 - RNA, 21 nt, Artificial Sequence
  Description of Artificial Sequence: Synthetic oligonucleotide
  modified_base (20)..(21): a, c, g, u, unknown or other
accuuucagaagcuacacunn

SEQ ID NO: 3317 - RNA, 21 nt, Artificial Sequence
  Description of Artificial Sequence: Synthetic oligonucleotide
  modified_base (20)..(21): a, c, g, u, unknown or other
caccuuucagaagcuacacnn

SEQ ID NO: 3318 - RNA, 21 nt, Artificial Sequence
  Description of Artificial Sequence: Synthetic oligonucleotide
  modified_base (20)..(21): a, c, g, u, unknown or other
gcaccuuucagaagcuacann

SEQ ID NO: 3319 - RNA, 21 nt, Artificial Sequence
  Description of Artificial Sequence: Synthetic oligonucleotide
  modified_base (20)..(21): a, c, g, u, unknown or other
agcaccuuucagaagcuacnn

SEQ ID NO: 3320 - RNA, 21 nt, Artificial Sequence
  Description of Artificial Sequence: Synthetic oligonucleotide
  modified_base (20)..(21): a, c, g, u, unknown or other
aagcaccuuucagaagcuann

SEQ ID NO: 3321 - RNA, 21 nt, Artificial Sequence
  Description of Artificial Sequence: Synthetic oligonucleotide
  modified_base (20)..(21): a, c, g, u, unknown or other
aaagcaccuuucagaagcunn

SEQ ID NO: 3322 - RNA, 21 nt, Artificial Sequence
  Description of Artificial Sequence: Synthetic oligonucleotide
  modified_base (20)..(21): a, c, g, u, unknown or other
gaaagcaccuuucagaagcnn

SEQ ID NO: 3323 - RNA, 21 nt, Artificial Sequence
  Description of Artificial Sequence: Synthetic oligonucleotide
  modified_base (20)..(21): a, c, g, u, unknown or other
guaguuuuaaauaaauggann

SEQ ID NO: 3324 - RNA, 21 nt, Artificial Sequence
  Description of Artificial Sequence: Synthetic oligonucleotide
  modified_base (20)..(21): a, c, g, u, unknown or other
gguaguuuuaaauaaauggnn

SEQ ID NO: 3325 - RNA, 21 nt, Artificial Sequence
  Description of Artificial Sequence: Synthetic oligonucleotide
  modified_base (20)..(21): a, c, g, u, unknown or other
ggguaguuuuaaauaaaugnn

SEQ ID NO: 3326 - RNA, 21 nt, Artificial Sequence
  Description of Artificial Sequence: Synthetic oligonucleotide
  modified_base (20)..(21): a, c, g, u, unknown or other
uggguaguuuuaaauaaaunn

SEQ ID NO: 3327 - RNA, 21 nt, Artificial Sequence
  Description of Artificial Sequence: Synthetic oligonucleotide
  modified_base (20)..(21): a, c, g, u, unknown or other
auggguaguuuuaaauaaann

SEQ ID NO: 3328 - RNA, 21 nt, Artificial Sequence
  Description of Artificial Sequence: Synthetic oligonucleotide
  modified_base (20)..(21): a, c, g, u, unknown or other
cauggguaguuuuaaauaann

SEQ ID NO: 3329 - RNA, 21 nt, Artificial Sequence
  Description of Artificial Sequence: Synthetic oligonucleotide
  modified_base (20)..(21): a, c, g, u, unknown or other
gcauggguaguuuuaaauann

SEQ ID NO: 3330 - RNA, 21 nt, Artificial Sequence
  Description of Artificial Sequence: Synthetic oligonucleotide
  modified_base (20)..(21): a, c, g, u, unknown or other
ugcauggguaguuuuaaaunn

SEQ ID NO: 3331 - RNA, 21 nt, Artificial Sequence
  Description of Artificial Sequence: Synthetic oligonucleotide
  modified_base (20)..(21): a, c, g, u, unknown or other
uugcauggguaguuuuaaann

SEQ ID NO: 3332 - RNA, 21 nt, Artificial Sequence
  Description of Artificial Sequence: Synthetic oligonucleotide
  modified_base (20)..(21): a, c, g, u, unknown or other
auugcauggguaguuuuaann

SEQ ID NO: 3333 - RNA, 21 nt, Artificial Sequence
  Description of Artificial Sequence: Synthetic oligonucleotide
  modified_base (20)..(21): a, c, g, u, unknown or other
aauugcauggguaguuuuann

SEQ ID NO: 3334 - RNA, 21 nt, Artificial Sequence
  Description of Artificial Sequence: Synthetic oligonucleotide
  modified_base (20)..(21): a, c, g, u, unknown or other
uaauugcauggguaguuuunn

SEQ ID NO: 3335 - RNA, 21 nt, Artificial Sequence
  Description of Artificial Sequence: Synthetic oligonucleotide
  modified_base (20)..(21): a, c, g, u, unknown or other
uuaauugcauggguaguuunn

SEQ ID NO: 3336 - RNA, 21 nt, Artificial Sequence
  Description of Artificial Sequence: Synthetic oligonucleotide
  modified_base (20)..(21): a, c, g, u, unknown or other
uuuaauugcauggguaguunn

SEQ ID NO: 3337 - RNA, 21 nt, Artificial Sequence
  Description of Artificial Sequence: Synthetic oligonucleotide
  modified_base (20)..(21): a, c, g, u, unknown or other
uuuuaauugcauggguagunn

SEQ ID NO: 3338 - RNA, 21 nt, Artificial Sequence
  Description of Artificial Sequence: Synthetic oligonucleotide
  modified_base (20)..(21): a, c, g, u, unknown or other
cuuuuaauugcauggguagnn

SEQ ID NO: 3339 - RNA, 21 nt, Artificial Sequence
  Description of Artificial Sequence: Synthetic oligonucleotide
  modified_base (20)..(21): a, c, g, u, unknown or other
ccuuuuaauugcauggguann

SEQ ID NO: 3340 - RNA, 21 nt, Artificial Sequence
  Description of Artificial Sequence: Synthetic oligonucleotide
  modified_base (20)..(21): a, c, g, u, unknown or other
accuuuuaauugcaugggunn

SEQ ID NO: 3341 - RNA, 21 nt, Artificial Sequence
  Description of Artificial Sequence: Synthetic oligonucleotide
  modified_base (20)..(21): a, c, g, u, unknown or other
uaccuuuuaauugcaugggnn

SEQ ID NO: 3342 - RNA, 21 nt, Artificial Sequence
  Description of Artificial Sequence: Synthetic oligonucleotide
  modified_base (20)..(21): a, c, g, u, unknown or other
guaccuuuuaauugcauggnn

SEQ ID NO: 3343 - RNA, 21 nt, Artificial Sequence
  Description of Artificial Sequence: Synthetic oligonucleotide
  modified_base (20)..(21): a, c, g, u, unknown or other
uguaccuuuuaauugcaugnn

SEQ ID NO: 3344 - RNA, 21 nt, Artificial Sequence
  Description of Artificial Sequence: Synthetic oligonucleotide
  modified_base (20)..(21): a, c, g, u, unknown or other
uuguaccuuuuaauugcaunn

SEQ ID NO: 3345 - RNA, 21 nt, Artificial Sequence
  Description of Artificial Sequence: Synthetic oligonucleotide
  modified_base (20)..(21): a, c, g, u, unknown or other
auuguaccuuuuaauugcann

SEQ ID NO: 3346 - RNA, 21 nt, Artificial Sequence
  Description of Artificial Sequence: Synthetic oligonucleotide
  modified_base (20)..(21): a, c, g, u, unknown or other
cauuguaccuuuuaauugcnn

SEQ ID NO: 3347 - RNA, 21 nt, Artificial Sequence
  Description of Artificial Sequence: Synthetic oligonucleotide
  modified_base (20)..(21): a, c, g, u, unknown or other
gcauuguaccuuuuaauugnn

SEQ ID NO: 3348 - RNA, 21 nt, Artificial Sequence
  Description of Artificial Sequence: Synthetic oligonucleotide
  modified_base (20)..(21): a, c, g, u, unknown or other
ugcauuguaccuuuuaauunn

SEQ ID NO: 3349 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
cgctcgctgcctccgggctnn

SEQ ID NO: 3350 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ccgctcgctgcctccgggcnn

SEQ ID NO: 3351 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
cccgctcgctgcctccgggnn

SEQ ID NO: 3352 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ccccgctcgctgcctccggnn

SEQ ID NO: 3353 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
cccccgctcgctgcctccgnn

SEQ ID NO: 3354 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ccccccgctcgctgcctccnn

SEQ ID NO: 3355 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
gccccccgctcgctgcctcnn

SEQ ID NO: 3356 - RNA, 21 nt, Artificial Sequence
  Description of Artificial Sequence: Synthetic oligonucleotide
  modified_base (20)..(21): a, c, g, u, unknown or other
agccccccgcucgcugccunn

SEQ ID NO: 3357 - RNA, 21 nt, Artificial Sequence
  Description of Artificial Sequence: Synthetic oligonucleotide
  modified_base (20)..(21): a, c, g, u, unknown or other
cagccccccgcucgcugccnn

SEQ ID NO: 3358 - RNA, 21 nt, Artificial Sequence
  Description of Artificial Sequence: Synthetic oligonucleotide
  modified_base (20)..(21): a, c, g, u, unknown or other
gcagccccccgcucgcugcnn

SEQ ID NO: 3359 - RNA, 21 nt, Artificial Sequence
  Description of Artificial Sequence: Synthetic oligonucleotide
  modified_base (20)..(21): a, c, g, u, unknown or other
ggcagccccccgcucgcugnn

SEQ ID NO: 3360 - RNA, 21 nt, Artificial Sequence
  Description of Artificial Sequence: Synthetic oligonucleotide
  modified_base (20)..(21): a, c, g, u, unknown or other
gggcagccccccgcucgcunn

SEQ ID NO: 3361 - RNA, 21 nt, Artificial Sequence
  Description of Artificial Sequence: Synthetic oligonucleotide
  modified_base (20)..(21): a, c, g, u, unknown or other
ggggcagccccccgcucgcnn

SEQ ID NO: 3362 - RNA, 21 nt, Artificial Sequence
  Description of Artificial Sequence: Synthetic oligonucleotide
  modified_base (20)..(21): a, c, g, u, unknown or other
uggggcagccccccgcucgnn

SEQ ID NO: 3363 - RNA, 21 nt, Artificial Sequence
  Description of Artificial Sequence: Synthetic oligonucleotide
  modified_base (20)..(21): a, c, g, u, unknown or other
cuggggcagccccccgcucnn

SEQ ID NO: 3364 - RNA, 21 nt, Artificial Sequence
  Description of Artificial Sequence: Synthetic oligonucleotide
  modified_base (20)..(21): a, c, g, u, unknown or other
ccuggggcagccccccgcunn

SEQ ID NO: 3365 - RNA, 21 nt, Artificial Sequence
  Description of Artificial Sequence: Synthetic oligonucleotide
  modified_base (20)..(21): a, c, g, u, unknown or other
gccuggggcagccccccgcnn

SEQ ID NO: 3366 - RNA, 21 nt, Artificial Sequence
  Description of Artificial Sequence: Synthetic oligonucleotide
  modified_base (20)..(21): a, c, g, u, unknown or other
cgccuggggcagccccccgnn

SEQ ID NO: 3367 - RNA, 21 nt, Artificial Sequence
  Description of Artificial Sequence: Synthetic oligonucleotide
  modified_base (20)..(21): a, c, g, u, unknown or other
gcgccuggggcagccccccnn

SEQ ID NO: 3368 - RNA, 21 nt, Artificial Sequence
  Description of Artificial Sequence: Synthetic oligonucleotide
  modified_base (20)..(21): a, c, g, u, unknown or other
cgcgccuggggcagcccccnn

SEQ ID NO: 3369 - RNA, 21 nt, Artificial Sequence
  Description of Artificial Sequence: Synthetic oligonucleotide
  modified_base (20)..(21): a, c, g, u, unknown or other
gcgcgccuggggcagccccnn

SEQ ID NO: 3370 - RNA, 21 nt, Artificial Sequence
  Description of Artificial Sequence: Synthetic oligonucleotide
  modified_base (20)..(21): a, c, g, u, unknown or other
ugcgcgccuggggcagcccnn

SEQ ID NO: 3371 - RNA, 21 nt, Artificial Sequence
  Description of Artificial Sequence: Synthetic oligonucleotide
  modified_base (20)..(21): a, c, g, u, unknown or other
uugcgcgccuggggcagccnn

SEQ ID NO: 3372 - RNA, 21 nt, Artificial Sequence
  Description of Artificial Sequence: Synthetic oligonucleotide
  modified_base (20)..(21): a, c, g, u, unknown or other
cuugcgcgccuggggcagcnn

SEQ ID NO: 3373 - RNA, 21 nt, Artificial Sequence
  Description of Artificial Sequence: Synthetic oligonucleotide
  modified_base (20)..(21): a, c, g, u, unknown or other
gcuugcgcgccuggggcagnn

SEQ ID NO: 3374 - RNA, 21 nt, Artificial Sequence
  Description of Artificial Sequence: Synthetic oligonucleotide
  modified_base (20)..(21): a, c, g, u, unknown or other
cgcuugcgcgccuggggcann

SEQ ID NO: 3375 - RNA, 21 nt, Artificial Sequence
  Description of Artificial Sequence: Synthetic oligonucleotide
  modified_base (20)..(21): a, c, g, u, unknown or other
ccuucuccucggggcucagnn

SEQ ID NO: 3376 - RNA, 21 nt, Artificial Sequence
  Description of Artificial Sequence: Synthetic oligonucleotide
  modified_base (20)..(21): a, c, g, u, unknown or other
gccuucuccucggggcucann

SEQ ID NO: 3377 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
cgccttctcctcggggctcnn

SEQ ID NO: 3378 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
gcgccttctcctcggggctnn

SEQ ID NO: 3379 - RNA, 21 nt, Artificial Sequence
  Description of Artificial Sequence: Synthetic oligonucleotide
  modified_base (20)..(21): a, c, g, u, unknown or other
agcgccuucuccucggggcnn

SEQ ID NO: 3380 - RNA, 21 nt, Artificial Sequence
  Description of Artificial Sequence: Synthetic oligonucleotide
  modified_base (20)..(21): a, c, g, u, unknown or other
cagcgccuucuccucggggnn

SEQ ID NO: 3381 - RNA, 21 nt, Artificial Sequence
  Description of Artificial Sequence: Synthetic oligonucleotide
  modified_base (20)..(21): a, c, g, u, unknown or other
ucagcgccuucuccucgggnn

SEQ ID NO: 3382 - RNA, 21 nt, Artificial Sequence
  Description of Artificial Sequence: Synthetic oligonucleotide
  modified_base (20)..(21): a, c, g, u, unknown or other
cucagcgccuucuccucggnn

SEQ ID NO: 3383 - RNA, 21 nt, Artificial Sequence
  Description of Artificial Sequence: Synthetic oligonucleotide
  modified_base (20)..(21): a, c, g, u, unknown or other
ccucagcgccuucuccucgnn

SEQ ID NO: 3384 - RNA, 21 nt, Artificial Sequence
  Description of Artificial Sequence: Synthetic oligonucleotide
  modified_base (20)..(21): a, c, g, u, unknown or other
uccucagcgccuucuccucnn

SEQ ID NO: 3385 - RNA, 21 nt, Artificial Sequence
  Description of Artificial Sequence: Synthetic oligonucleotide
  modified_base (20)..(21): a, c, g, u, unknown or other
cuccucagcgccuucuccunn

SEQ ID NO: 3386 - RNA, 21 nt, Artificial Sequence
  Description of Artificial Sequence: Synthetic oligonucleotide
  modified_base (20)..(21): a, c, g, u, unknown or other
ccuccucagcgccuucuccnn

SEQ ID NO: 3387 - RNA, 21 nt, Artificial Sequence
  Description of Artificial Sequence: Synthetic oligonucleotide
  modified_base (20)..(21): a, c, g, u, unknown or other
uccuccucagcgccuucucnn

SEQ ID NO: 3388 - RNA, 21 nt, Artificial Sequence
  Description of Artificial Sequence: Synthetic oligonucleotide
  modified_base (20)..(21): a, c, g, u, unknown or other
uuccuccucagcgccuucunn

SEQ ID NO: 3389 - RNA, 21 nt, Artificial Sequence
  Description of Artificial Sequence: Synthetic oligonucleotide
  modified_base (20)..(21): a, c, g, u, unknown or other
uuuccuccucagcgccuucnn

SEQ ID NO: 3390 - RNA, 21 nt, Artificial Sequence
  Description of Artificial Sequence: Synthetic oligonucleotide
  modified_base (20)..(21): a, c, g, u, unknown or other
guuuccuccucagcgccuunn

SEQ ID NO: 3391 - RNA, 21 nt, Artificial Sequence
  Description of Artificial Sequence: Synthetic oligonucleotide
  modified_base (20)..(21): a, c, g, u, unknown or other
aguuuccuccucagcgccunn

SEQ ID NO: 3392 - RNA, 21 nt, Artificial Sequence
  Description of Artificial Sequence: Synthetic oligonucleotide
  modified_base (20)..(21): a, c, g, u, unknown or other
caguuuccuccucagcgccnn

SEQ ID NO: 3393 - RNA, 21 nt, Artificial Sequence
  Description of Artificial Sequence: Synthetic oligonucleotide
  modified_base (20)..(21): a, c, g, u, unknown or other
ucaguuuccuccucagcgcnn

SEQ ID NO: 3394 - RNA, 21 nt, Artificial Sequence
  Description of Artificial Sequence: Synthetic oligonucleotide
  modified_base (20)..(21): a, c, g, u, unknown or other
uucaguuuccuccucagcgnn

SEQ ID NO: 3395 - RNA, 21 nt, Artificial Sequence
  Description of Artificial Sequence: Synthetic oligonucleotide
  modified_base (20)..(21): a, c, g, u, unknown or other
uuucaguuuccuccucagcnn

SEQ ID NO: 3396 - RNA, 21 nt, Artificial Sequence
  Description of Artificial Sequence: Synthetic oligonucleotide
  modified_base (20)..(21): a, c, g, u, unknown or other
uuuucaguuuccuccucagnn

SEQ ID NO: 3397 - RNA, 21 nt, Artificial Sequence
  Description of Artificial Sequence: Synthetic oligonucleotide
  modified_base (20)..(21): a, c, g, u, unknown or other
uuuuucaguuuccuccucann

SEQ ID NO: 3398 - RNA, 21 nt, Artificial Sequence
  Description of Artificial Sequence: Synthetic oligonucleotide
  modified_base (20)..(21): a, c, g, u, unknown or other
guuuuucaguuuccuccucnn

SEQ ID NO: 3399 - RNA, 21 nt, Artificial Sequence
  Description of Artificial Sequence: Synthetic oligonucleotide
  modified_base (20)..(21): a, c, g, u, unknown or other
uguuuuucaguuuccuccunn

SEQ ID NO: 3400 - RNA, 21 nt, Artificial Sequence
  Description of Artificial Sequence: Synthetic oligonucleotide
  modified_base (20)..(21): a, c, g, u, unknown or other
cuguuuuucaguuuccuccnn

SEQ ID NO: 3401 - RNA, 21 nt, Artificial Sequence
  Description of Artificial Sequence: Synthetic oligonucleotide
  modified_base (20)..(21): a, c, g, u, unknown or other
ucuguuuuucaguuuccucnn

SEQ ID NO: 3402 - RNA, 21 nt, Artificial Sequence
  Description of Artificial Sequence: Synthetic oligonucleotide
  modified_base (20)..(21): a, c, g, u, unknown or other
cucuguuuuucaguuuccunn

SEQ ID NO: 3403 - RNA, 21 nt, Artificial Sequence
  Description of Artificial Sequence: Synthetic oligonucleotide
  modified_base (20)..(21): a, c, g, u, unknown or other
acucuguuuuucaguuuccnn

SEQ ID NO: 3404 - RNA, 21 nt, Artificial Sequence
  Description of Artificial Sequence: Synthetic oligonucleotide
  modified_base (20)..(21): a, c, g, u, unknown or other
uacucuguuuuucaguuucnn

SEQ ID NO: 3405 - RNA, 21 nt, Artificial Sequence
  Description of Artificial Sequence: Synthetic oligonucleotide
  modified_base (20)..(21): a, c, g, u, unknown or other
cuacucuguuuuucaguuunn

SEQ ID NO: 3406 - RNA, 21 nt, Artificial Sequence
  Description of Artificial Sequence: Synthetic oligonucleotide
  modified_base (20)..(21): a, c, g, u, unknown or other
gcuacucuguuuuucaguunn

SEQ ID NO: 3407 - RNA, 21 nt, Artificial Sequence
  Description of Artificial Sequence: Synthetic oligonucleotide
  modified_base (20)..(21): a, c, g, u, unknown or other
ugcuacucuguuuuucagunn

SEQ ID NO: 3408 - RNA, 21 nt, Artificial Sequence
  Description of Artificial Sequence: Synthetic oligonucleotide
  modified_base (20)..(21): a, c, g, u, unknown or other
cugcuacucuguuuuucagnn

SEQ ID NO: 3409 - RNA, 21 nt, Artificial Sequence
  Description of Artificial Sequence: Synthetic oligonucleotide
  modified_base (20)..(21): a, c, g, u, unknown or other
gcugcuacucuguuuuucann

SEQ ID NO: 3410 - RNA, 21 nt, Artificial Sequence
  Description of Artificial Sequence: Synthetic oligonucleotide
  modified_base (20)..(21): a, c, g, u, unknown or other
agcugcuacucuguuuuucnn

SEQ ID NO: 3411 - RNA, 21 nt, Artificial Sequence
  Description of Artificial Sequence: Synthetic oligonucleotide
  modified_base (20)..(21): a, c, g, u, unknown or other
gagcugcuacucuguuuuunn

SEQ ID NO: 3412 - RNA, 21 nt, Artificial Sequence
  Description of Artificial Sequence: Synthetic oligonucleotide
  modified_base (20)..(21): a, c, g, u, unknown or other
ugagcugcuacucuguuuunn

SEQ ID NO: 3413 - RNA, 21 nt, Artificial Sequence
  Description of Artificial Sequence: Synthetic oligonucleotide
  modified_base (20)..(21): a, c, g, u, unknown or other
cugagcugcuacucuguuunn

SEQ ID NO: 3414 - RNA, 21 nt, Artificial Sequence
  Description of Artificial Sequence: Synthetic oligonucleotide
  modified_base (20)..(21): a, c, g, u, unknown or other
ucugagcugcuacucuguunn

SEQ ID NO: 3415 - RNA, 21 nt, Artificial Sequence
  Description of Artificial Sequence: Synthetic oligonucleotide
  modified_base (20)..(21): a, c, g, u, unknown or other
gucugagcugcuacucugunn

SEQ ID NO: 3416 - RNA, 21 nt, Artificial Sequence
  Description of Artificial Sequence: Synthetic oligonucleotide
  modified_base (20)..(21): a, c, g, u, unknown or other
agucugagcugcuacucugnn

SEQ ID NO: 3417 - RNA, 21 nt, Artificial Sequence
  Description of Artificial Sequence: Synthetic oligonucleotide
  modified_base (20)..(21): a, c, g, u, unknown or other
cagucugagcugcuacucunn

SEQ ID NO: 3418 - RNA, 21 nt, Artificial Sequence
  Description of Artificial Sequence: Synthetic oligonucleotide
  modified_base (20)..(21): a, c, g, u, unknown or other
gcagucugagcugcuacucnn

SEQ ID NO: 3419 - RNA, 21 nt, Artificial Sequence
  Description of Artificial Sequence: Synthetic oligonucleotide
  modified_base (20)..(21): a, c, g, u, unknown or other
ggcagucugagcugcuacunn

SEQ ID NO: 3420 - RNA, 21 nt, Artificial Sequence
  Description of Artificial Sequence: Synthetic oligonucleotide
  modified_base (20)..(21): a, c, g, u, unknown or other
uggcagucugagcugcuacnn

SEQ ID NO: 3421 - RNA, 21 nt, Artificial Sequence
  Description of Artificial Sequence: Synthetic oligonucleotide
  modified_base (20)..(21): a, c, g, u, unknown or other
cuggcagucugagcugcuann

SEQ ID NO: 3422 - RNA, 21 nt, Artificial Sequence
  Description of Artificial Sequence: Synthetic oligonucleotide
  modified_base (20)..(21): a, c, g, u, unknown or other
ucuggcagucugagcugcunn

SEQ ID NO: 3423 - RNA, 21 nt, Artificial Sequence
  Description of Artificial Sequence: Synthetic oligonucleotide
  modified_base (20)..(21): a, c, g, u, unknown or other
cucuggcagucugagcugcnn

SEQ ID NO: 3424 - RNA, 21 nt, Artificial Sequence
  Description of Artificial Sequence: Synthetic oligonucleotide
  modified_base (20)..(21): a, c, g, u, unknown or other
ucucuggcagucugagcugnn

SEQ ID NO: 3425 - RNA, 21 nt, Artificial Sequence
  Description of Artificial Sequence: Synthetic oligonucleotide
  modified_base (20)..(21): a, c, g, u, unknown or other
aucucuggcagucugagcunn

SEQ ID NO: 3426 - RNA, 21 nt, Artificial Sequence
  Description of Artificial Sequence: Synthetic oligonucleotide
  modified_base (20)..(21): a, c, g, u, unknown or other
gaucucuggcagucugagcnn

SEQ ID NO: 3427 - RNA, 21 nt, Artificial Sequence
  Description of Artificial Sequence: Synthetic oligonucleotide
  modified_base (20)..(21): a, c, g, u, unknown or other
cgaucucuggcagucugagnn

SEQ ID NO: 3428 - RNA, 21 nt, Artificial Sequence
  Description of Artificial Sequence: Synthetic oligonucleotide
  modified_base (20)..(21): a, c, g, u, unknown or other
ucgaucucuggcagucugann

SEQ ID NO: 3429 - RNA, 21 nt, Artificial Sequence
  Description of Artificial Sequence: Synthetic oligonucleotide
  modified_base (20)..(21): a, c, g, u, unknown or other
uucgaucucuggcagucugnn

SEQ ID NO: 3430 - RNA, 21 nt, Artificial Sequence
  Description of Artificial Sequence: Synthetic oligonucleotide
  modified_base (20)..(21): a, c, g, u, unknown or other
uuucgaucucuggcagucunn

SEQ ID NO: 3431 - RNA, 21 nt, Artificial Sequence
  Description of Artificial Sequence: Synthetic oligonucleotide
  modified_base (20)..(21): a, c, g, u, unknown or other
cuuucgaucucuggcagucnn

SEQ ID NO: 3432 - RNA, 21 nt, Artificial Sequence
  Description of Artificial Sequence: Synthetic oligonucleotide
  modified_base (20)..(21): a, c, g, u, unknown or other
ucuuucgaucucuggcagunn

SEQ ID NO: 3433 - RNA, 21 nt, Artificial Sequence
  Description of Artificial Sequence: Synthetic oligonucleotide
  modified_base (20)..(21): a, c, g, u, unknown or other
uucuuucgaucucuggcagnn

SEQ ID NO: 3434 - RNA, 21 nt, Artificial Sequence
  Description of Artificial Sequence: Synthetic oligonucleotide
  modified_base (20)..(21): a, c, g, u, unknown or other
ccagcucacucauucgagcnn

SEQ ID NO: 3435 - RNA, 21 nt, Artificial Sequence
  Description of Artificial Sequence: Synthetic oligonucleotide
  modified_base (20)..(21): a, c, g, u, unknown or other
uccagcucacucauucgagnn

SEQ ID NO: 3436 - RNA, 21 nt, Artificial Sequence
  Description of Artificial Sequence: Synthetic oligonucleotide
  modified_base (20)..(21): a, c, g, u, unknown or other
uuccagcucacucauucgann

SEQ ID NO: 3437 - RNA, 21 nt, Artificial Sequence
  Description of Artificial Sequence: Synthetic oligonucleotide
  modified_base (20)..(21): a, c, g, u, unknown or other
guuccagcucacucauucgnn

SEQ ID NO: 3438 - RNA, 21 nt, Artificial Sequence
  Description of Artificial Sequence: Synthetic oligonucleotide
  modified_base (20)..(21): a, c, g, u, unknown or other
uguuccagcucacucauucnn

SEQ ID NO: 3439 - RNA, 21 nt, Artificial Sequence
  Description of Artificial Sequence: Synthetic oligonucleotide
  modified_base (20)..(21): a, c, g, u, unknown or other
cuguuccagcucacucauunn

SEQ ID NO: 3440 - RNA, 21 nt, Artificial Sequence
  Description of Artificial Sequence: Synthetic oligonucleotide
  modified_base (20)..(21): a, c, g, u, unknown or other
gcuguuccagcucacucaunn

SEQ ID NO: 3441 - RNA, 21 nt, Artificial Sequence
  Description of Artificial Sequence: Synthetic oligonucleotide
  modified_base (20)..(21): a, c, g, u, unknown or other
ugcuguuccagcucacucann

SEQ ID NO: 3442 - RNA, 21 nt, Artificial Sequence
  Description of Artificial Sequence: Synthetic oligonucleotide
  modified_base (20)..(21): a, c, g, u, unknown or other
uugcuguuccagcucacucnn

SEQ ID NO: 3443 - RNA, 21 nt, Artificial Sequence
  Description of Artificial Sequence: Synthetic oligonucleotide
  modified_base (20)..(21): a, c, g, u, unknown or other
cuugcuguuccagcucacunn

SEQ ID NO: 3444 - RNA, 21 nt, Artificial Sequence
  Description of Artificial Sequence: Synthetic oligonucleotide
  modified_base (20)..(21): a, c, g, u, unknown or other
acuugcuguuccagcucacnn

SEQ ID NO: 3445 - RNA, 21 nt, Artificial Sequence
  Description of Artificial Sequence: Synthetic oligonucleotide
  modified_base (20)..(21): a, c, g, u, unknown or other
cacuugcuguuccagcucann

SEQ ID NO: 3446 - RNA, 21 nt, Artificial Sequence
  Description of Artificial Sequence: Synthetic oligonucleotide
  modified_base (20)..(21): a, c, g, u, unknown or other
ccacuugcuguuccagcucnn

SEQ ID NO: 3447 - RNA, 21 nt, Artificial Sequence
  Description of Artificial Sequence: Synthetic oligonucleotide
  modified_base (20)..(21): a, c, g, u, unknown or other
accacuugcuguuccagcunn

SEQ ID NO: 3448 - RNA, 21 nt, Artificial Sequence
  Description of Artificial Sequence: Synthetic oligonucleotide
  modified_base (20)..(21): a, c, g, u, unknown or other
uaccacuugcuguuccagcnn

SEQ ID NO: 3449 - RNA, 21 nt, Artificial Sequence
  Description of Artificial Sequence: Synthetic oligonucleotide
  modified_base (20)..(21): a, c, g, u, unknown or other
cuaccacuugcuguuccagnn

SEQ ID NO: 3450 - RNA, 21 nt, Artificial Sequence
  Description of Artificial Sequence: Synthetic oligonucleotide
  modified_base (20)..(21): a, c, g, u, unknown or other
ucuaccacuugcuguuccann

SEQ ID NO: 3451 - RNA, 21 nt, Artificial Sequence
  Description of Artificial Sequence: Synthetic oligonucleotide
  modified_base (20)..(21): a, c, g, u, unknown or other
aucuaccacuugcuguuccnn

SEQ ID NO: 3452 - RNA, 21 nt, Artificial Sequence
  Description of Artificial Sequence: Synthetic oligonucleotide
  modified_base (20)..(21): a, c, g, u, unknown or other
aaucuaccacuugcuguucnn

SEQ ID NO: 3453 - RNA, 21 nt, Artificial Sequence
  Description of Artificial Sequence: Synthetic oligonucleotide
  modified_base (20)..(21): a, c, g, u, unknown or other
aaaucuaccacuugcuguunn

SEQ ID NO: 3454 - RNA, 21 nt, Artificial Sequence
  Description of Artificial Sequence: Synthetic oligonucleotide
  modified_base (20)..(21): a, c, g, u, unknown or other
uaaaucuaccacuugcugunn

SEQ ID NO: 3455 - RNA, 21 nt, Artificial Sequence
  Description of Artificial Sequence: Synthetic oligonucleotide
  modified_base (20)..(21): a, c, g, u, unknown or other
cuaaaucuaccacuugcugnn

SEQ ID NO: 3456 - RNA, 21 nt, Artificial Sequence
  Description of Artificial Sequence: Synthetic oligonucleotide
  modified_base (20)..(21): a, c, g, u, unknown or other
ucuaaaucuaccacuugcunn

SEQ ID NO: 3457 - RNA, 21 nt, Artificial Sequence
  Description of Artificial Sequence: Synthetic oligonucleotide
  modified_base (20)..(21): a, c, g, u, unknown or other
uucuaaaucuaccacuugcnn

SEQ ID NO: 3458 - RNA, 21 nt, Artificial Sequence
  Description of Artificial Sequence: Synthetic oligonucleotide
  modified_base (20)..(21): a, c, g, u, unknown or other
cuucuaaaucuaccacuugnn

SEQ ID NO: 3459 - RNA, 21 nt, Artificial Sequence
  Description of Artificial Sequence: Synthetic oligonucleotide
  modified_base (20)..(21): a, c, g, u, unknown or other
ucuucuaaaucuaccacuunn

SEQ ID NO: 3460 - RNA, 21 nt, Artificial Sequence
  Description of Artificial Sequence: Synthetic oligonucleotide
  modified_base (20)..(21): a, c, g, u, unknown or other
uucuucuaaaucuaccacunn

SEQ ID NO: 3461 - RNA, 21 nt, Artificial Sequence
  Description of Artificial Sequence: Synthetic oligonucleotide
  modified_base (20)..(21): a, c, g, u, unknown or other
cuucuucuaaaucuaccacnn

SEQ ID NO: 3462 - RNA, 21 nt, Artificial Sequence
  Description of Artificial Sequence: Synthetic oligonucleotide
  modified_base (20)..(21): a, c, g, u, unknown or other
ucuucuucuaaaucuaccann

SEQ ID NO: 3463 - RNA, 21 nt, Artificial Sequence
  Description of Artificial Sequence: Synthetic oligonucleotide
  modified_base (20)..(21): a, c, g, u, unknown or other
cucuucuucuaaaucuaccnn

SEQ ID NO: 3464 - RNA, 21 nt, Artificial Sequence
  Description of Artificial Sequence: Synthetic oligonucleotide
  modified_base (20)..(21): a, c, g, u, unknown or other
ucucuucuucuaaaucuacnn

SEQ ID NO: 3465 - RNA, 21 nt, Artificial Sequence
  Description of Artificial Sequence: Synthetic oligonucleotide
  modified_base (20)..(21): a, c, g, u, unknown or other
uucucuucuucuaaaucuann

SEQ ID NO: 3466 - RNA, 21 nt, Artificial Sequence
  Description of Artificial Sequence: Synthetic oligonucleotide
  modified_base (20)..(21): a, c, g, u, unknown or other
guucucuucuucuaaaucunn

SEQ ID NO: 3467 - RNA, 21 nt, Artificial Sequence
  Description of Artificial Sequence: Synthetic oligonucleotide
  modified_base (20)..(21): a, c, g, u, unknown or other
gguucucuucuucuaaaucnn

SEQ ID NO: 3468 - RNA, 21 nt, Artificial Sequence
  Description of Artificial Sequence: Synthetic oligonucleotide
  modified_base (20)..(21): a, c, g, u, unknown or other
ugguucucuucuucuaaaunn

SEQ ID NO: 3469 - RNA, 21 nt, Artificial Sequence
  Description of Artificial Sequence: Synthetic oligonucleotide
  modified_base (20)..(21): a, c, g, u, unknown or other
uugguucucuucuucuaaann

SEQ ID NO: 3470 - RNA, 21 nt, Artificial Sequence
  Description of Artificial Sequence: Synthetic oligonucleotide
  modified_base (20)..(21): a, c, g, u, unknown or other
uuugguucucuucuucuaann

SEQ ID NO: 3471 - RNA, 21 nt, Artificial Sequence
  Description of Artificial Sequence: Synthetic oligonucleotide
  modified_base (20)..(21): a, c, g, u, unknown or other
uuuugguucucuucuucuann

SEQ ID NO: 3472 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
tttttggttctcttcttctnn

SEQ ID NO: 3473 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
gtttttggttctcttcttcnn

SEQ ID NO: 3474 - RNA, 21 nt, Artificial Sequence
  Description of Artificial Sequence: Synthetic oligonucleotide
  modified_base (20)..(21): a, c, g, u, unknown or other
aguuuuugguucucuucuunn

SEQ ID NO: 3475 - RNA, 21 nt, Artificial Sequence
  Description of Artificial Sequence: Synthetic oligonucleotide
  modified_base (20)..(21): a, c, g, u, unknown or other
aaguuuuugguucucuucunn

SEQ ID NO: 3476 - RNA, 21 nt, Artificial Sequence
  Description of Artificial Sequence: Synthetic oligonucleotide
  modified_base (20)..(21): a, c, g, u, unknown or other
aaaguuuuugguucucuucnn

SEQ ID NO: 3477 - RNA, 21 nt, Artificial Sequence
  Description of Artificial Sequence: Synthetic oligonucleotide
  modified_base (20)..(21): a, c, g, u, unknown or other
aaaaguuuuugguucucuunn

SEQ ID NO: 3478 - RNA, 21 nt, Artificial Sequence
  Description of Artificial Sequence: Synthetic oligonucleotide
  modified_base (20)..(21): a, c, g, u, unknown or other
caaaaguuuuugguucucunn

SEQ ID NO: 3479 - RNA, 21 nt, Artificial Sequence
  Description of Artificial Sequence: Synthetic oligonucleotide
  modified_base (20)..(21): a, c, g, u, unknown or other
gcaaaaguuuuugguucucnn

SEQ ID NO: 3480 - RNA, 21 nt, Artificial Sequence
  Description of Artificial Sequence: Synthetic oligonucleotide
  modified_base (20)..(21): a, c, g, u, unknown or other
agcaaaaguuuuugguucunn

SEQ ID NO: 3481 - RNA, 21 nt, Artificial Sequence
  Description of Artificial Sequence: Synthetic oligonucleotide
  modified_base (20)..(21): a, c, g, u, unknown or other
uagcaaaaguuuuugguucnn

SEQ ID NO: 3482 - RNA, 21 nt, Artificial Sequence
  Description of Artificial Sequence: Synthetic oligonucleotide
  modified_base (20)..(21): a, c, g, u, unknown or other
cuagcaaaaguuuuugguunn

SEQ ID NO: 3483 - RNA, 21 nt, Artificial Sequence
  Description of Artificial Sequence: Synthetic oligonucleotide
  modified_base (20)..(21): a, c, g, u, unknown or other
ucuagcaaaaguuuuuggunn

SEQ ID NO: 3484 - RNA, 21 nt, Artificial Sequence
  Description of Artificial Sequence: Synthetic oligonucleotide
  modified_base (20)..(21): a, c, g, u, unknown or other
uucuagcaaaaguuuuuggnn

SEQ ID NO: 3485 - RNA, 21 nt, Artificial Sequence
  Description of Artificial Sequence: Synthetic oligonucleotide
  modified_base (20)..(21): a, c, g, u, unknown or other
uuucuagcaaaaguuuuugnn

SEQ ID NO: 3486 - RNA, 21 nt, Artificial Sequence
  Description of Artificial Sequence: Synthetic oligonucleotide
  modified_base (20)..(21): a, c, g, u, unknown or other
uuuucuagcaaaaguuuuunn

SEQ ID NO: 3487 - RNA, 21 nt, Artificial Sequence
  Description of Artificial Sequence: Synthetic oligonucleotide
  modified_base (20)..(21): a, c, g, u, unknown or other
auuuucuagcaaaaguuuunn

SEQ ID NO: 3488 - RNA, 21 nt, Artificial Sequence
  Description of Artificial Sequence: Synthetic oligonucleotide
  modified_base (20)..(21): a, c, g, u, unknown or other
gauuuucuagcaaaaguuunn

SEQ ID NO: 3489 - RNA, 21 nt, Artificial Sequence
  Description of Artificial Sequence: Synthetic oligonucleotide
  modified_base (20)..(21): a, c, g, u, unknown or other
ugauuuucuagcaaaaguunn

SEQ ID NO: 3490 - RNA, 21 nt, Artificial Sequence
  Description of Artificial Sequence: Synthetic oligonucleotide
  modified_base (20)..(21): a, c, g, u, unknown or other
cugauuuucuagcaaaagunn

SEQ ID NO: 3491 - RNA, 21 nt, Artificial Sequence
  Description of Artificial Sequence: Synthetic oligonucleotide
  modified_base (20)..(21): a, c, g, u, unknown or other
gcugauuuucuagcaaaagnn

SEQ ID NO: 3492 - RNA, 21 nt, Artificial Sequence
  Description of Artificial Sequence: Synthetic oligonucleotide
  modified_base (20)..(21): a, c, g, u, unknown or other
agcugauuuucuagcaaaann

SEQ ID NO: 3493 - RNA, 21 nt, Artificial Sequence
  Description of Artificial Sequence: Synthetic oligonucleotide
  modified_base (20)..(21): a, c, g, u, unknown or other
aagcugauuuucuagcaaann

SEQ ID NO: 3494 - RNA, 21 nt, Artificial Sequence
  Description of Artificial Sequence: Synthetic oligonucleotide
  modified_base (20)..(21): a, c, g, u, unknown or other
aaagcugauuuucuagcaann

SEQ ID NO: 3495 - RNA, 21 nt, Artificial Sequence
  Description of Artificial Sequence: Synthetic oligonucleotide
  modified_base (20)..(21): a, c, g, u, unknown or other
aaaagcugauuuucuagcann

SEQ ID NO: 3496 - RNA, 21 nt, Artificial Sequence
  Description of Artificial Sequence: Synthetic oligonucleotide
  modified_base (20)..(21): a, c, g, u, unknown or other
uaaaagcugauuuucuagcnn

SEQ ID NO: 3497 - RNA, 21 nt, Artificial Sequence
  Description of Artificial Sequence: Synthetic oligonucleotide
  modified_base (20)..(21): a, c, g, u, unknown or other
guaaaagcugauuuucuagnn

SEQ ID NO: 3498 - RNA, 21 nt, Artificial Sequence
  Description of Artificial Sequence: Synthetic oligonucleotide
  modified_base (20)..(21): a, c, g, u, unknown or other
cguaaaagcugauuuucuann

SEQ ID NO: 3499 - RNA, 21 nt, Artificial Sequence
  Description of Artificial Sequence: Synthetic oligonucleotide
  modified_base (20)..(21): a, c, g, u, unknown or other
ucguaaaagcugauuuucunn

SEQ ID NO: 3500 - RNA, 21 nt, Artificial Sequence
  Description of Artificial Sequence: Synthetic oligonucleotide
  modified_base (20)..(21): a, c, g, u, unknown or other
cucguaaaagcugauuuucnn

SEQ ID NO: 3501 - RNA, 21 nt, Artificial Sequence
  Description of Artificial Sequence: Synthetic oligonucleotide
  modified_base (20)..(21): a, c, g, u, unknown or other
ucucguaaaagcugauuuunn

SEQ ID NO: 3502 - RNA, 21 nt, Artificial Sequence
  Description of Artificial Sequence: Synthetic oligonucleotide
  modified_base (20)..(21): a, c, g, u, unknown or other
cucucguaaaagcugauuunn

SEQ ID NO: 3503 - RNA, 21 nt, Artificial Sequence
  Description of Artificial Sequence: Synthetic oligonucleotide
  modified_base (20)..(21): a, c, g, u, unknown or other
ucucucguaaaagcugauunn

SEQ ID NO: 3504 - RNA, 21 nt, Artificial Sequence
  Description of Artificial Sequence: Synthetic oligonucleotide
  modified_base (20)..(21): a, c, g, u, unknown or other
uucucucguaaaagcugaunn

SEQ ID NO: 3505 - RNA, 21 nt, Artificial Sequence
  Description of Artificial Sequence: Synthetic oligonucleotide
  modified_base (20)..(21): a, c, g, u, unknown or other
uuucucucguaaaagcugann

SEQ ID NO: 3506 - RNA, 21 nt, Artificial Sequence
  Description of Artificial Sequence: Synthetic oligonucleotide
  modified_base (20)..(21): a, c, g, u, unknown or other
uuuucucucguaaaagcugnn

SEQ ID NO: 3507 - RNA, 21 nt, Artificial Sequence
  Description of Artificial Sequence: Synthetic oligonucleotide
  modified_base (20)..(21): a, c, g, u, unknown or other
guuuucucucguaaaagcunn

SEQ ID NO: 3508 - RNA, 21 nt, Artificial Sequence
  Description of Artificial Sequence: Synthetic oligonucleotide
  modified_base (20)..(21): a, c, g, u, unknown or other
aguuuucucucguaaaagcnn

SEQ ID NO: 3509 - RNA, 21 nt, Artificial Sequence
  Description of Artificial Sequence: Synthetic oligonucleotide
  modified_base (20)..(21): a, c, g, u, unknown or other
gaguuuucucucguaaaagnn

SEQ ID NO: 3510 - RNA, 21 nt, Artificial Sequence
  Description of Artificial Sequence: Synthetic oligonucleotide
  modified_base (20)..(21): a, c, g, u, unknown or other
ugaguuuucucucguaaaann

SEQ ID NO: 3511 - RNA, 21 nt, Artificial Sequence
  Description of Artificial Sequence: Synthetic oligonucleotide
  modified_base (20)..(21): a, c, g, u, unknown or other
gguucucaacuacaaggccnn

SEQ ID NO: 3512 - RNA, 21 nt, Artificial Sequence
  Description of Artificial Sequence: Synthetic oligonucleotide
  modified_base (20)..(21): a, c, g, u, unknown or other
ugguucucaacuacaaggcnn

SEQ ID NO: 3513 - RNA, 21 nt, Artificial Sequence
  Description of Artificial Sequence: Synthetic oligonucleotide
  modified_base (20)..(21): a, c, g, u, unknown or other
cugguucucaacuacaaggnn

SEQ ID NO: 3514 - RNA, 21 nt, Artificial Sequence
  Description of Artificial Sequence: Synthetic oligonucleotide
  modified_base (20)..(21): a, c, g, u, unknown or other
ccugguucucaacuacaagnn

SEQ ID NO: 3515 - RNA, 21 nt, Artificial Sequence
  Description of Artificial Sequence: Synthetic oligonucleotide
  modified_base (20)..(21): a, c, g, u, unknown or other
uccugguucucaacuacaann

SEQ ID NO: 3516 - RNA, 21 nt, Artificial Sequence
  Description of Artificial Sequence: Synthetic oligonucleotide
  modified_base (20)..(21): a, c, g, u, unknown or other
cuccugguucucaacuacann

SEQ ID NO: 3517 - RNA, 21 nt, Artificial Sequence
  Description of Artificial Sequence: Synthetic oligonucleotide
  modified_base (20)..(21): a, c, g, u, unknown or other
acuccugguucucaacuacnn

SEQ ID NO: 3518 - RNA, 21 nt, Artificial Sequence
  Description of Artificial Sequence: Synthetic oligonucleotide
  modified_base (20)..(21): a, c, g, u, unknown or other
aacuccugguucucaacuann

SEQ ID NO: 3519 - RNA, 21 nt, Artificial Sequence
  Description of Artificial Sequence: Synthetic oligonucleotide
  modified_base (20)..(21): a, c, g, u, unknown or other
uaacuccugguucucaacunn

SEQ ID NO: 3520 - RNA, 21 nt, Artificial Sequence
  Description of Artificial Sequence: Synthetic oligonucleotide
  modified_base (20)..(21): a, c, g, u, unknown or other
uuaacuccugguucucaacnn

SEQ ID NO: 3521 - RNA, 21 nt, Artificial Sequence
  Description of Artificial Sequence: Synthetic oligonucleotide
  modified_base (20)..(21): a, c, g, u, unknown or other
cuuaacuccugguucucaann

SEQ ID NO: 3522 - RNA, 21 nt, Artificial Sequence
  Description of Artificial Sequence: Synthetic oligonucleotide
  modified_base (20)..(21): a, c, g, u, unknown or other
ucuuaacuccugguucucann

SEQ ID NO: 3523 - RNA, 21 nt, Artificial Sequence
  Description of Artificial Sequence: Synthetic oligonucleotide
  modified_base (20)..(21): a, c, g, u, unknown or other
gucuuaacuccugguucucnn

SEQ ID NO: 3524 - RNA, 21 nt, Artificial Sequence
  Description of Artificial Sequence: Synthetic oligonucleotide
  modified_base (20)..(21): a, c, g, u, unknown or other
ugucuuaacuccugguucunn

SEQ ID NO: 3525 - RNA, 21 nt, Artificial Sequence
  Description of Artificial Sequence: Synthetic oligonucleotide
  modified_base (20)..(21): a, c, g, u, unknown or other
cugucuuaacuccugguucnn

SEQ ID NO: 3526 - RNA, 21 nt, Artificial Sequence
  Description of Artificial Sequence: Synthetic oligonucleotide
  modified_base (20)..(21): a, c, g, u, unknown or other
gcugucuuaacuccugguunn

SEQ ID NO: 3527 - RNA, 21 nt, Artificial Sequence
  Description of Artificial Sequence: Synthetic oligonucleotide
  modified_base (20)..(21): a, c, g, u, unknown or other
cgcugucuuaacuccuggunn

SEQ ID NO: 3528 - RNA, 21 nt, Artificial Sequence
  Description of Artificial Sequence: Synthetic oligonucleotide
  modified_base (20)..(21): a, c, g, u, unknown or other
gcgcugucuuaacuccuggnn

SEQ ID NO: 3529 - RNA, 21 nt, Artificial Sequence
  Description of Artificial Sequence: Synthetic oligonucleotide
  modified_base (20)..(21): a, c, g, u, unknown or other
gccaccaccaccauagcucnn

SEQ ID NO: 3530 - RNA, 21 nt, Artificial Sequence
  Description of Artificial Sequence: Synthetic oligonucleotide
  modified_base (20)..(21): a, c, g, u, unknown or other
ugccaccaccaccauagcunn

SEQ ID NO: 3531 - RNA, 21 nt, Artificial Sequence
  Description of Artificial Sequence: Synthetic oligonucleotide
  modified_base (20)..(21): a, c, g, u, unknown or other
accagggcauccauccccann

SEQ ID NO: 3532 - RNA, 21 nt, Artificial Sequence
  Description of Artificial Sequence: Synthetic oligonucleotide
  modified_base (20)..(21): a, c, g, u, unknown or other
aaccagggcauccauccccnn

SEQ ID NO: 3533 - RNA, 21 nt, Artificial Sequence
  Description of Artificial Sequence: Synthetic oligonucleotide
  modified_base (20)..(21): a, c, g, u, unknown or other
caaccagggcauccaucccnn

SEQ ID NO: 3534 - RNA, 21 nt, Artificial Sequence
  Description of Artificial Sequence: Synthetic oligonucleotide
  modified_base (20)..(21): a, c, g, u, unknown or other
gcaaccagggcauccauccnn

SEQ ID NO: 3535 - RNA, 21 nt, Artificial Sequence
  Description of Artificial Sequence: Synthetic oligonucleotide
  modified_base (20)..(21): a, c, g, u, unknown or other
agcaaccagggcauccaucnn

SEQ ID NO: 3536 - RNA, 21 nt, Artificial Sequence
  Description of Artificial Sequence: Synthetic oligonucleotide
  modified_base (20)..(21): a, c, g, u, unknown or other
cugccaccaccaccauagcnn

SEQ ID NO: 3537 - RNA, 21 nt, Artificial Sequence
  Description of Artificial Sequence: Synthetic oligonucleotide
  modified_base (20)..(21): a, c, g, u, unknown or other
gcugccaccaccaccauagnn

SEQ ID NO: 3538 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ttggcttccgcctcctcttnn

SEQ ID NO: 3539 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
cttggcttccgcctcctctnn

SEQ ID NO: 3540 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ccttggcttccgcctcctcnn

SEQ ID NO: 3541 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
cccttggcttccgcctcctnn

SEQ ID NO: 3542 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ccccttggcttccgcctccnn

SEQ ID NO: 3543 - RNA, 21 nt, Artificial Sequence
  Description of Artificial Sequence: Synthetic oligonucleotide
  modified_base (20)..(21): a, c, g, u, unknown or other
ggcugccaccaccaccauann

SEQ ID NO: 3544 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
tccccttggcttccgcctcnn

SEQ ID NO: 3545 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): a, c, g, t, u, unknown or other
ttccccttggcttccgcctnn

SEQ ID NO: 3546 - RNA, 21 nt, Artificial Sequence
  Description of Artificial Sequence: Synthetic oligonucleotide
  modified_base (20)..(21): a, c, g, u, unknown or other
auuccccuuggcuuccgccnn

SEQ ID NO: 3547 - RNA, 21 nt, Artificial Sequence
  Description of Artificial Sequence: Synthetic oligonucleotide
  modified_base (20)..(21): a, c, g, u, unknown or other
cauuccccuuggcuuccgcnn

SEQ ID NO: 3548 - RNA, 21 nt, Artificial Sequence
  Description of Artificial Sequence: Synthetic oligonucleotide
  modified_base (20)..(21): a, c, g, u, unknown or other
cggcugccaccaccaccaunn

SEQ ID NO: 3549 - RNA, 21 nt, Artificial Sequence
  Description of Artificial Sequence: Synthetic oligonucleotide
  modified_base (20)..(21): a, c, g, u, unknown or other
gcggcugccaccaccaccann

SEQ ID NO: 3550 - RNA, 21 nt, Artificial Sequence
  Description of Artificial Sequence: Synthetic oligonucleotide
  modified_base (20)..(21): a, c, g, u, unknown or other
cccggccacuggccucacunn

SEQ ID NO: 3551 - RNA, 21 nt, Artificial Sequence
  Description of Artificial Sequence: Synthetic oligonucleotide
  modified_base (20)..(21): a, c, g, u, unknown or other
acccggccacuggccucacnn

SEQ ID NO: 3552 - RNA, 21 nt, Artificial Sequence
  Description of Artificial Sequence: Synthetic oligonucleotide
  modified_base (20)..(21): a, c, g, u, unknown or other
gacccggccacuggccucann

SEQ ID NO: 3553 - RNA, 21 nt, Artificial Sequence
  Description of Artificial Sequence: Synthetic oligonucleotide
  modified_base (20)..(21): a, c, g, u, unknown or other
agacccggccacuggccucnn

SEQ ID NO: 3554 - RNA, 21 nt, Artificial Sequence
  Description of Artificial Sequence: Synthetic oligonucleotide
  modified_base (20)..(21): a, c, g, u, unknown or other
cagacccggccacuggccunn

SEQ ID NO: 3555 - RNA, 21 nt, Artificial Sequence
  Description of Artificial Sequence: Synthetic oligonucleotide
  modified_base (20)..(21): a, c, g, u, unknown or other
gcagacccggccacuggccnn

SEQ ID NO: 3556 - RNA, 21 nt, Artificial Sequence
  Description of Artificial Sequence: Synthetic oligonucleotide
  modified_base (20)..(21): a, c, g, u, unknown or other
agcagacccggccacuggcnn

SEQ ID NO: 3557 - RNA, 21 nt, Artificial Sequence
  Description of Artificial Sequence: Synthetic oligonucleotide
  modified_base (20)..(21): a, c, g, u, unknown or other
cagcagacccggccacuggnn

SEQ ID NO: 3558 - RNA, 21 nt, Artificial Sequence
  Description of Artificial Sequence: Synthetic oligonucleotide
  modified_base (20)..(21): a, c, g, u, unknown or other
ucagcagacccggccacugnn

SEQ ID NO: 3559 - RNA, 21 nt, Artificial Sequence
  Description of Artificial Sequence: Synthetic oligonucleotide
  modified_base (20)..(21): a, c, g, u, unknown or other
cucagcagacccggccacunn

SEQ ID NO: 3560 - RNA, 21 nt, Artificial Sequence
  Description of Artificial Sequence: Synthetic oligonucleotide
  modified_base (20)..(21): a, c, g, u, unknown or other
acucagcagacccggccacnn

SEQ ID NO: 3561 - RNA, 21 nt, Artificial Sequence
  Description of Artificial Sequence: Synthetic oligonucleotide
  modified_base (20)..(21): a, c, g, u, unknown or other
gacucagcagacccggccann

SEQ ID NO: 3562 - RNA, 21 nt, Artificial Sequence
  Description of Artificial Sequence: Synthetic oligonucleotide
  modified_base (20)..(21): a, c, g, u, unknown or other
ggacucagcagacccggccnn

SEQ ID NO: 3563 - RNA, 21 nt, Artificial Sequence
  Description of Artificial Sequence: Synthetic oligonucleotide
  modified_base (20)..(21): a, c, g, u, unknown or other
cggacucagcagacccggcnn

SEQ ID NO: 3564 - RNA, 21 nt, Artificial Sequence
  Description of Artificial Sequence: Synthetic oligonucleotide
  modified_base (20)..(21): a, c, g, u, unknown or other
gcggacucagcagacccggnn

SEQ ID NO: 3565 - RNA, 21 nt, Artificial Sequence
  Description of Artificial Sequence: Synthetic oligonucleotide
  modified_base (20)..(21): a, c, g, u, unknown or other
ugcggacucagcagacccgnn

SEQ ID NO: 3566 - RNA, 21 nt, Artificial Sequence
  Description of Artificial Sequence: Synthetic oligonucleotide
  modified_base (20)..(21): a, c, g, u, unknown or other
cugcggacucagcagacccnn

SEQ ID NO: 3567 - RNA, 21 nt, Artificial Sequence
  Description of Artificial Sequence: Synthetic oligonucleotide
  modified_base (20)..(21): a, c, g, u, unknown or other
gugacaacugggccugcacnn

SEQ ID NO: 3568 - RNA, 21 nt, Artificial Sequence
  Description of Artificial Sequence: Synthetic oligonucleotide
  modified_base (20)..(21): a, c, g, u, unknown or other
ggugacaacugggccugcann

SEQ ID NO: 3569 - RNA, 21 nt, Artificial Sequence
  Description of Artificial Sequence: Synthetic oligonucleotide
  modified_base (20)..(21): a, c, g, u, unknown or other
gggugacaacugggccugcnn

SEQ ID NO: 3570 - RNA, 21 nt, Artificial Sequence
  Description of Artificial Sequence: Synthetic oligonucleotide
  modified_base (20)..(21): a, c, g, u, unknown or other
ggggugacaacugggccugnn

SEQ ID NO: 3571 - RNA, 21 nt, Artificial Sequence
  Description of Artificial Sequence: Synthetic oligonucleotide
  modified_base (20)..(21): a, c, g, u, unknown or other
aggggugacaacugggccunn

SEQ ID NO: 3572 - RNA, 21 nt, Artificial Sequence
  Description of Artificial Sequence: Synthetic oligonucleotide
  modified_base (20)..(21): a, c, g, u, unknown or other
gaggggugacaacugggccnn

SEQ ID NO: 3573 - RNA, 21 nt, Artificial Sequence
  Description of Artificial Sequence: Synthetic oligonucleotide
  modified_base (20)..(21): a, c, g, u, unknown or other
ggaggggugacaacugggcnn

SEQ ID NO: 3574 - RNA, 21 nt, Artificial Sequence
  Description of Artificial Sequence: Synthetic oligonucleotide
  modified_base (20)..(21): a, c, g, u, unknown or other
uggaggggugacaacugggnn

SEQ ID NO: 3575 - RNA, 21 nt, Artificial Sequence
  Description of Artificial Sequence: Synthetic oligonucleotide
  modified_base (20)..(21): a, c, g, u, unknown or other
cuggaggggugacaacuggnn

SEQ ID NO: 3576 - RNA, 21 nt, Artificial Sequence
  Description of Artificial Sequence: Synthetic oligonucleotide
  modified_base (20)..(21): a, c, g, u, unknown or other
ucuggaggggugacaacugnn

SEQ ID NO: 3577 - RNA, 21 nt, Artificial Sequence
  Description of Artificial Sequence: Synthetic oligonucleotide
  modified_base (20)..(21): a, c, g, u, unknown or other
uucuggaggggugacaacunn

SEQ ID NO: 3578 - RNA, 21 nt, Artificial Sequence
  Description of Artificial Sequence: Synthetic oligonucleotide
  modified_base (20)..(21): a, c, g, u, unknown or other
guucuggaggggugacaacnn

SEQ ID NO: 3579 - RNA, 21 nt, Artificial Sequence
  Description of Artificial Sequence: Synthetic oligonucleotide
  modified_base (20)..(21): a, c, g, u, unknown or other
uguucuggaggggugacaann

SEQ ID NO: 3580 - RNA, 21 nt, Artificial Sequence
  Description of Artificial Sequence: Synthetic oligonucleotide
  modified_base (20)..(21): a, c, g, u, unknown or other
auguucuggaggggugacann

SEQ ID NO: 3581 - RNA, 21 nt, Artificial Sequence
  Description of Artificial Sequence: Synthetic oligonucleotide
  modified_base (20)..(21): a, c, g, u, unknown or other
gauguucuggaggggugacnn

SEQ ID NO: 3582 - RNA, 21 nt, Artificial Sequence
  Description of Artificial Sequence: Synthetic oligonucleotide
  modified_base (20)..(21): a, c, g, u, unknown or other
agauguucuggaggggugann

SEQ ID NO: 3583 - RNA, 21 nt, Artificial Sequence
  Description of Artificial Sequence: Synthetic oligonucleotide
  modified_base (20)..(21): a, c, g, u, unknown or other
gagauguucuggaggggugnn

SEQ ID NO: 3584 - RNA, 21 nt, Artificial Sequence
  Description of Artificial Sequence: Synthetic oligonucleotide
  modified_base (20)..(21): a, c, g, u, unknown or other
ggagauguucuggaggggunn

SEQ ID NO: 3585 - RNA, 21 nt, Artificial Sequence
  Description of Artificial Sequence: Synthetic oligonucleotide
  modified_base (20)..(21): a, c, g, u, unknown or other
gggagauguucuggaggggnn

SEQ ID NO: 3586 - RNA, 21 nt, Artificial Sequence
  Description of Artificial Sequence: Synthetic oligonucleotide
  modified_base (20)..(21): a, c, g, u, unknown or other
ggggagauguucuggagggnn

SEQ ID NO: 3587 - RNA, 21 nt, Artificial Sequence
  Description of Artificial Sequence: Synthetic oligonucleotide
  modified_base (20)..(21): a, c, g, u, unknown or other
uggggagauguucuggaggnn

SEQ ID NO: 3588 - RNA, 21 nt, Artificial Sequence
  Description of Artificial Sequence: Synthetic oligonucleotide
  modified_base (20)..(21): a, c, g, u, unknown or other
auggggagauguucuggagnn

SEQ ID NO: 3589 - RNA, 21 nt, Artificial Sequence
  Description of Artificial Sequence: Synthetic oligonucleotide
  modified_base (20)..(21): a, c, g, u, unknown or other
cauggggagauguucuggann

SEQ ID NO: 3590 - RNA, 21 nt, Artificial Sequence
  Description of Artificial Sequence: Synthetic oligonucleotide
  modified_base (20)..(21): a, c, g, u, unknown or other
ccauggggagauguucuggnn

SEQ ID NO: 3591 - RNA, 21 nt, Artificial Sequence
  Description of Artificial Sequence: Synthetic oligonucleotide
  modified_base (20)..(21): a, c, g, u, unknown or other
uccauggggagauguucugnn

SEQ ID NO: 3592 - RNA, 21 nt, Artificial Sequence
  Description of Artificial Sequence: Synthetic oligonucleotide
  modified_base (20)..(21): a, c, g, u, unknown or other
auccauggggagauguucunn

SEQ ID NO: 3593 - RNA, 21 nt, Artificial Sequence
  Description of Artificial Sequence: Synthetic oligonucleotide
  modified_base (20)..(21): a, c, g, u, unknown or other
aauccauggggagauguucnn

SEQ ID NO: 3594 - RNA, 21 nt, Artificial Sequence
  Description of Artificial Sequence: Synthetic oligonucleotide
  modified_base (20)..(21): a, c, g, u, unknown or other
gaauccauggggagauguunn

SEQ ID NO: 3595 - RNA, 21 nt, Artificial Sequence
  Description of Artificial Sequence: Synthetic oligonucleotide
  modified_base (20)..(21): a, c, g, u, unknown or other
agaauccauggggagaugunn

SEQ ID NO: 3596 - RNA, 21 nt, Artificial Sequence
  Description of Artificial Sequence: Synthetic oligonucleotide
  modified_base (20)..(21): a, c, g, u, unknown or other
cagaauccauggggagaugnn

SEQ ID NO: 3597 - RNA, 21 nt, Artificial Sequence
  Description of Artificial Sequence: Synthetic oligonucleotide
  modified_base (20)..(21): a, c, g, u, unknown or other
ccagaauccauggggagaunn

SEQ ID NO: 3598 - RNA, 21 nt, Artificial Sequence
  Description of Artificial Sequence: Synthetic oligonucleotide
  modified_base (20)..(21): a, c, g, u, unknown or other
gccagaauccauggggagann

SEQ ID NO: 3599 - RNA, 21 nt, Artificial Sequence
  Description of Artificial Sequence: Synthetic oligonucleotide
  modified_base (20)..(21): a, c, g, u, unknown or other
cgccagaauccauggggagnn

SEQ ID NO: 3600 - RNA, 21 nt, Artificial Sequence
  Description of Artificial Sequence: Synthetic oligonucleotide
  modified_base (20)..(21): a, c, g, u, unknown or other
ccgccagaauccauggggann

SEQ ID NO: 3601 - RNA, 21 nt, Artificial Sequence
  Description of Artificial Sequence: Synthetic oligonucleotide
  modified_base (20)..(21): a, c, g, u, unknown or other
accgccagaauccauggggnn

SEQ ID NO: 3602 - RNA, 21 nt, Artificial Sequence
  Description of Artificial Sequence: Synthetic oligonucleotide
  modified_base (20)..(21): a, c, g, u, unknown or other
uaccgccagaauccaugggnn

SEQ ID NO: 3603 - RNA, 21 nt, Artificial Sequence
  Description of Artificial Sequence: Synthetic oligonucleotide
  modified_base (20)..(21): a, c, g, u, unknown or other
auaccgccagaauccauggnn

SEQ ID NO: 3604 - RNA, 21 nt, Artificial Sequence
  Description of Artificial Sequence: Synthetic oligonucleotide
  modified_base (20)..(21): a, c, g, u, unknown or other
aauaccgccagaauccaugnn

SEQ ID NO: 3605 - RNA, 21 nt, Artificial Sequence
  Description of Artificial Sequence: Synthetic oligonucleotide
  modified_base (20)..(21): a, c, g, u, unknown or other
caauaccgccagaauccaunn

SEQ ID NO: 3606 - RNA, 21 nt, Artificial Sequence
  Description of Artificial Sequence: Synthetic oligonucleotide
  modified_base (20)..(21): a, c, g, u, unknown or other
ucaauaccgccagaauccann

SEQ ID NO: 3607 - RNA, 21 nt, Artificial Sequence
  Description of Artificial Sequence: Synthetic oligonucleotide
  modified_base (20)..(21): a, c, g, u, unknown or other
gucaauaccgccagaauccnn

SEQ ID NO: 3608 - RNA, 21 nt, Artificial Sequence
  Description of Artificial Sequence: Synthetic oligonucleotide
  modified_base (20)..(21): a, c, g, u, unknown or other
agucaauaccgccagaaucnn

SEQ ID NO: 3609 - RNA, 21 nt, Artificial Sequence
  Description of Artificial Sequence: Synthetic oligonucleotide
  modified_base (20)..(21): a, c, g, u, unknown or other
gagucaauaccgccagaaunn

SEQ ID NO: 3610 - RNA, 21 nt, Artificial Sequence
  Description of Artificial Sequence: Synthetic oligonucleotide
  modified_base (20)..(21): a, c, g, u, unknown or other
agagucaauaccgccagaann

SEQ ID NO: 3611 - RNA, 21 nt, Artificial Sequence
  Description of Artificial Sequence: Synthetic oligonucleotide
  modified_base (20)..(21): a, c, g, u, unknown or other
aagagucaauaccgccagann

SEQ ID NO: 3612 - RNA, 21 nt, Artificial Sequence
  Description of Artificial Sequence: Synthetic oligonucleotide
  modified_base (20)..(21): a, c, g, u, unknown or other
gaagagucaauaccgccagnn

SEQ ID NO: 3613 - RNA, 21 nt, Artificial Sequence
  Description of Artificial Sequence: Synthetic oligonucleotide
  modified_base (20)..(21): a, c, g, u, unknown or other
ugaagagucaauaccgccann

SEQ ID NO: 3614 - RNA, 21 nt, Artificial Sequence
  Description of Artificial Sequence: Synthetic oligonucleotide
  modified_base (20)..(21): a, c, g, u, unknown or other
cugaagagucaauaccgccnn

SEQ ID NO: 3615 - RNA, 21 nt, Artificial Sequence
  Description of Artificial Sequence: Synthetic oligonucleotide
  modified_base (20)..(21): a, c, g, u, unknown or other
ucugaagagucaauaccgcnn

SEQ ID NO: 3616 - RNA, 21 nt, Artificial Sequence
  Description of Artificial Sequence: Synthetic oligonucleotide
  modified_base (20)..(21): a, c, g, u, unknown or other
aucugaagagucaauaccgnn

SEQ ID NO: 3617 - RNA, 21 nt, Artificial Sequence
  Description of Artificial Sequence: Synthetic oligonucleotide
  modified_base (20)..(21): a, c, g, u, unknown or other
aaucugaagagucaauaccnn

SEQ ID NO: 3618 - RNA, 21 nt, Artificial Sequence
  Description of Artificial Sequence: Synthetic oligonucleotide
  modified_base (20)..(21): a, c, g, u, unknown or other
gaaucugaagagucaauacnn

SEQ ID NO: 3619 - RNA, 21 nt, Artificial Sequence
  Description of Artificial Sequence: Synthetic oligonucleotide
  modified_base (20)..(21): a, c, g, u, unknown or other
ugaaucugaagagucaauann

SEQ ID NO: 3620 - RNA, 21 nt, Artificial Sequence
  Description of Artificial Sequence: Synthetic oligonucleotide
  modified_base (20)..(21): a, c, g, u, unknown or other
cugaaucugaagagucaaunn

SEQ ID NO: 3621 - RNA, 21 nt, Artificial Sequence
  Description of Artificial Sequence: Synthetic oligonucleotide
  modified_base (20)..(21): a, c, g, u, unknown or other
ucugaaucugaagagucaann

SEQ ID NO: 3622 - RNA, 21 nt, Artificial Sequence
  Description of Artificial Sequence: Synthetic oligonucleotide
  modified_base (20)..(21): a, c, g, u, unknown or other
cucugaaucugaagagucann

SEQ ID NO: 3623 - RNA, 21 nt, Artificial Sequence
  Description of Artificial Sequence: Synthetic oligonucleotide
  modified_base (20)..(21): a, c, g, u, unknown or other
acucugaaucugaagagucnn

SEQ ID NO: 3624 - RNA, 21 nt, Artificial Sequence
  Description of Artificial Sequence: Synthetic oligonucleotide
  modified_base (20)..(21): a, c, g, u, unknown or other
gacucugaaucugaagagunn

SEQ ID NO: 3625 - RNA, 21 nt, Artificial Sequence
  Description of Artificial Sequence: Synthetic oligonucleotide
  modified_base (20)..(21): a, c, g, u, unknown or other
agacucugaaucugaagagnn

SEQ ID NO: 3626 - RNA, 21 nt, Artificial Sequence
  Description of Artificial Sequence: Synthetic oligonucleotide
  modified_base (20)..(21): a, c, g, u, unknown or other
cagacucugaaucugaagann

SEQ ID NO: 3627 - RNA, 21 nt, Artificial Sequence
  Description of Artificial Sequence: Synthetic oligonucleotide
  modified_base (20)..(21): a, c, g, u, unknown or other
ucagacucugaaucugaagnn

SEQ ID NO: 3628 - RNA, 21 nt, Artificial Sequence
  Description of Artificial Sequence: Synthetic oligonucleotide
  modified_base (20)..(21): a, c, g, u, unknown or other
aucagacucugaaucugaann

SEQ ID NO: 3629 - RNA, 21 nt, Artificial Sequence
  Description of Artificial Sequence: Synthetic oligonucleotide
  modified_base (20)..(21): a, c, g, u, unknown or other
uaucagacucugaaucugann

SEQ ID NO: 3630 - RNA, 21 nt, Artificial Sequence
  Description of Artificial Sequence: Synthetic oligonucleotide
  modified_base (20)..(21): a, c, g, u, unknown or other
auaucagacucugaaucugnn

SEQ ID NO: 3631 - RNA, 21 nt, Artificial Sequence
  Description of Artificial Sequence: Synthetic oligonucleotide
  modified_base (20)..(21): a, c, g, u, unknown or other
gauaucagacucugaaucunn

SEQ ID NO: 3632 - RNA, 21 nt, Artificial Sequence
  Description of Artificial Sequence: Synthetic oligonucleotide
  modified_base (20)..(21): a, c, g, u, unknown or other
ggauaucagacucugaaucnn

SEQ ID NO: 3633 - RNA, 21 nt, Artificial Sequence
  Description of Artificial Sequence: Synthetic oligonucleotide
  modified_base (20)..(21): a, c, g, u, unknown or other
aggauaucagacucugaaunn

SEQ ID NO: 3634 - RNA, 21 nt, Artificial Sequence
  Description of Artificial Sequence: Synthetic oligonucleotide
  modified_base (20)..(21): a, c, g, u, unknown or other
caggauaucagacucugaann

SEQ ID NO: 3635 - RNA, 21 nt, Artificial Sequence
  Description of Artificial Sequence: Synthetic oligonucleotide
  modified_base (20)..(21): a, c, g, u, unknown or other
acaggauaucagacucugann

SEQ ID NO: 3636 - RNA, 21 nt, Artificial Sequence
  Description of Artificial Sequence: Synthetic oligonucleotide
  modified_base (20)..(21): a, c, g, u, unknown or other
aacaggauaucagacucugnn

SEQ ID NO: 3637 - RNA, 21 nt, Artificial Sequence
  Description of Artificial Sequence: Synthetic oligonucleotide
  modified_base (20)..(21): a, c, g, u, unknown or other
caacaggauaucagacucunn

SEQ ID NO: 3638 - RNA, 21 nt, Artificial Sequence
  Description of Artificial Sequence: Synthetic oligonucleotide
  modified_base (20)..(21): a, c, g, u, unknown or other
ccaacaggauaucagacucnn

SEQ ID NO: 3639 - RNA, 21 nt, Artificial Sequence
  Description of Artificial Sequence: Synthetic oligonucleotide
  modified_base (20)..(21): a, c, g, u, unknown or other
cccaacaggauaucagacunn

SEQ ID NO: 3640 - RNA, 21 nt, Artificial Sequence
  Description of Artificial Sequence: Synthetic oligonucleotide
  modified_base (20)..(21): a, c, g, u, unknown or other
gcccaacaggauaucagacnn

SEQ ID NO: 3641 - RNA, 21 nt, Artificial Sequence
  Description of Artificial Sequence: Synthetic oligonucleotide
  modified_base (20)..(21): a, c, g, u, unknown or other
ugcccaacaggauaucagann

SEQ ID NO: 3642 - RNA, 21 nt, Artificial Sequence
  Description of Artificial Sequence: Synthetic oligonucleotide
  modified_base (20)..(21): a, c, g, u, unknown or other
augcccaacaggauaucagnn

SEQ ID NO: 3643 - RNA, 21 nt, Artificial Sequence
  Description of Artificial Sequence: Synthetic oligonucleotide
  modified_base (20)..(21): a, c, g, u, unknown or other
aaugcccaacaggauaucann

SEQ ID NO: 3644 - RNA, 21 nt, Artificial Sequence
  Description of Artificial Sequence: Synthetic oligonucleotide
  modified_base (20)..(21): a, c, g, u, unknown or other
gaaugcccaacaggauaucnn

SEQ ID NO: 3645 - RNA, 21 nt, Artificial Sequence
  Description of Artificial Sequence: Synthetic oligonucleotide
  modified_base (20)..(21): a, c, g, u, unknown or other
agaaugcccaacaggauaunn

SEQ ID NO: 3646 - RNA, 21 nt, Artificial Sequence
  Description of Artificial Sequence: Synthetic oligonucleotide
  modified_base (20)..(21): a, c, g, u, unknown or other
cagaaugcccaacaggauann

SEQ ID NO: 3647 - RNA, 21 nt, Artificial Sequence
  Description of Artificial Sequence: Synthetic oligonucleotide
  modified_base (20)..(21): a, c, g, u, unknown or other
ccagaaugcccaacaggaunn

SEQ ID NO: 3648 - RNA, 21 nt, Artificial Sequence
  Description of Artificial Sequence: Synthetic oligonucleotide
  modified_base (20)..(21): a, c, g, u, unknown or other
uccagaaugcccaacaggann

SEQ ID NO: 3649 - RNA, 21 nt, Artificial Sequence
  Description of Artificial Sequence: Synthetic oligonucleotide
  modified_base (20)..(21): a, c, g, u, unknown or other
guccagaaugcccaacaggnn

SEQ ID NO: 3650 - RNA, 21 nt, Artificial Sequence
  Description of Artificial Sequence: Synthetic oligonucleotide
  modified_base (20)..(21): a, c, g, u, unknown or other
uguccagaaugcccaacagnn

SEQ ID NO: 3651 - RNA, 21 nt, Artificial Sequence
  Description of Artificial Sequence: Synthetic oligonucleotide
  modified_base (20)..(21): a, c, g, u, unknown or other
uuguccagaaugcccaacann

SEQ ID NO: 3652 - RNA, 21 nt, Artificial Sequence
  Description of Artificial Sequence: Synthetic oligonucleotide
  modified_base (20)..(21): a, c, g, u, unknown or other
guuguccagaaugcccaacnn

SEQ ID NO: 3653 - RNA, 21 nt, Artificial Sequence
  Description of Artificial Sequence: Synthetic oligonucleotide
  modified_base (20)..(21): a, c, g, u, unknown or other
aguuguccagaaugcccaann

SEQ ID NO: 3654 - RNA, 21 nt, Artificial Sequence
  Description of Artificial Sequence: Synthetic oligonucleotide
  modified_base (20)..(21): a, c, g, u, unknown or other
aaguuguccagaaugcccann

SEQ ID NO: 3655 - RNA, 21 nt, Artificial Sequence
  Description of Artificial Sequence: Synthetic oligonucleotide
  modified_base (20)..(21): a, c, g, u, unknown or other
caaguuguccagaaugcccnn

SEQ ID NO: 3656 - RNA, 21 nt, Artificial Sequence
  Description of Artificial Sequence: Synthetic oligonucleotide
  modified_base (20)..(21): a, c, g, u, unknown or other
ccaaguuguccagaaugccnn

SEQ ID NO: 3657 - RNA, 21 nt, Artificial Sequence
  Description of Artificial Sequence: Synthetic oligonucleotide
  modified_base (20)..(21): a, c, g, u, unknown or other
uccaaguuguccagaaugcnn

SEQ ID NO: 3658 - RNA, 21 nt, Artificial Sequence
  Description of Artificial Sequence: Synthetic oligonucleotide
  modified_base (20)..(21): a, c, g, u, unknown or other
guccaaguuguccagaaugnn

SEQ ID NO: 3659 - RNA, 21 nt, Artificial Sequence
  Description of Artificial Sequence: Synthetic oligonucleotide
  modified_base (20)..(21): a, c, g, u, unknown or other
gguccaaguuguccagaaunn

SEQ ID NO: 3660 - RNA, 21 nt, Artificial Sequence
  Description of Artificial Sequence: Synthetic oligonucleotide
  modified_base (20)..(21): a, c, g, u, unknown or other
ggguccaaguuguccagaann

SEQ ID NO: 3661 - RNA, 21 nt, Artificial Sequence
  Description of Artificial Sequence: Synthetic oligonucleotide
  modified_base (20)..(21): a, c, g, u, unknown or other
uggguccaaguuguccagann

SEQ ID NO: 3662 - RNA, 21 nt, Artificial Sequence
  Description of Artificial Sequence: Synthetic oligonucleotide
  modified_base (20)..(21): a, c, g, u, unknown or other
cuggguccaaguuguccagnn

SEQ ID NO: 3663 - RNA, 21 nt, Artificial Sequence
  Description of Artificial Sequence: Synthetic oligonucleotide
  modified_base (20)..(21): a, c, g, u, unknown or other
acuggguccaaguuguccann

SEQ ID NO: 3664 - RNA, 21 nt, Artificial Sequence
  Description of Artificial Sequence: Synthetic oligonucleotide
  modified_base (20)..(21): a, c, g, u, unknown or other
gacuggguccaaguuguccnn

SEQ ID NO: 3665 - RNA, 21 nt, Artificial Sequence
  Description of Artificial Sequence: Synthetic oligonucleotide
  modified_base (20)..(21): a, c, g, u, unknown or other
ugacuggguccaaguugucnn

SEQ ID NO: 3666 - RNA, 21 nt, Artificial Sequence
  Description of Artificial Sequence: Synthetic oligonucleotide
  modified_base (20)..(21): a, c, g, u, unknown or other
augacuggguccaaguugunn

SEQ ID NO: 3667 - RNA, 21 nt, Artificial Sequence
  Description of Artificial Sequence: Synthetic oligonucleotide
  modified_base (20)..(21): a, c, g, u, unknown or other
caugacuggguccaaguugnn

SEQ ID NO: 3668 - RNA, 21 nt, Artificial Sequence
  Description of Artificial Sequence: Synthetic oligonucleotide
  modified_base (20)..(21): a, c, g, u, unknown or other
acaugacuggguccaaguunn

SEQ ID NO: 3669 - RNA, 21 nt, Artificial Sequence
  Description of Artificial Sequence: Synthetic oligonucleotide
  modified_base (20)..(21): a, c, g, u, unknown or other
aacaugacuggguccaagunn

SEQ ID NO: 3670 - RNA, 21 nt, Artificial Sequence
  Description of Artificial Sequence: Synthetic oligonucleotide
  modified_base (20)..(21): a, c, g, u, unknown or other
gaacaugacuggguccaagnn

SEQ ID NO: 3671 - RNA, 21 nt, Artificial Sequence
  Description of Artificial Sequence: Synthetic oligonucleotide
  modified_base (20)..(21): a, c, g, u, unknown or other
agaacaugacuggguccaann

SEQ ID NO: 3672 - RNA, 21 nt, Artificial Sequence
  Description of Artificial Sequence: Synthetic oligonucleotide
  modified_base (20)..(21): a, c, g, u, unknown or other
aagaacaugacuggguccann

SEQ ID NO: 3673 - RNA, 21 nt, Artificial Sequence
  Description of Artificial Sequence: Synthetic oligonucleotide
  modified_base (20)..(21): a, c, g, u, unknown or other
gaagaacaugacuggguccnn

SEQ ID NO: 3674 - RNA, 21 nt, Artificial Sequence
  Description of Artificial Sequence: Synthetic oligonucleotide
  modified_base (20)..(21): a, c, g, u, unknown or other
ugaagaacaugacugggucnn

SEQ ID NO: 3675 - RNA, 21 nt, Artificial Sequence
  Description of Artificial Sequence: Synthetic oligonucleotide
  modified_base (20)..(21): a, c, g, u, unknown or other
uugaagaacaugacugggunn

SEQ ID NO: 3676 - RNA, 21 nt, Artificial Sequence
  Description of Artificial Sequence: Synthetic oligonucleotide
  modified_base (20)..(21): a, c, g, u, unknown or other
uuugaagaacaugacugggnn

SEQ ID NO: 3677 - RNA, 21 nt, Artificial Sequence
  Description of Artificial Sequence: Synthetic oligonucleotide
  modified_base (20)..(21): a, c, g, u, unknown or other
auuugaagaacaugacuggnn

SEQ ID NO: 3678 - RNA, 21 nt, Artificial Sequence
  Description of Artificial Sequence: Synthetic oligonucleotide
  modified_base (20)..(21): a, c, g, u, unknown or other
cauuugaagaacaugacugnn

SEQ ID NO: 3679 - RNA, 21 nt, Artificial Sequence
  Description of Artificial Sequence: Synthetic oligonucleotide
  modified_base (20)..(21): a, c, g, u, unknown or other
gcauuugaagaacaugacunn

SEQ ID NO: 3680 - RNA, 21 nt, Artificial Sequence
  Description of Artificial Sequence: Synthetic oligonucleotide
  modified_base (20)..(21): a, c, g, u, unknown or other
ggcauuugaagaacaugacnn

SEQ ID NO: 3681 - RNA, 21 nt, Artificial Sequence
  Description of Artificial Sequence: Synthetic oligonucleotide
  modified_base (20)..(21): a, c, g, u, unknown or other
gggcauuugaagaacaugann

SEQ ID NO: 3682 - RNA, 21 nt, Artificial Sequence
  Description of Artificial Sequence: Synthetic oligonucleotide
  modified_base (20)..(21): a, c, g, u, unknown or other
agggcauuugaagaacaugnn

SEQ ID NO: 3683 - RNA, 21 nt, Artificial Sequence
  Description of Artificial Sequence: Synthetic oligonucleotide
  modified_base (20)..(21): a, c, g, u, unknown or other
aagggcauuugaagaacaunn

SEQ ID NO: 3684 - RNA, 21 nt, Artificial Sequence
  Description of Artificial Sequence: Synthetic oligonucleotide
  modified_base (20)..(21): a, c, g, u, unknown or other
gaagggcauuugaagaacann

SEQ ID NO: 3685 - RNA, 21 nt, Artificial Sequence
  Description of Artificial Sequence: Synthetic oligonucleotide
  modified_base (20)..(21): a, c, g, u, unknown or other
ggaagggcauuugaagaacnn

SEQ ID NO: 3686 - RNA, 21 nt, Artificial Sequence
  Description of Artificial Sequence: Synthetic oligonucleotide
  modified_base (20)..(21): a, c, g, u, unknown or other
gggaagggcauuugaagaann

SEQ ID NO: 3687 - RNA, 21 nt, Artificial Sequence
  Description of Artificial Sequence: Synthetic oligonucleotide
  modified_base (20)..(21): a, c, g, u, unknown or other
ggggaagggcauuugaagann

SEQ ID NO: 3688 - RNA, 21 nt, Artificial Sequence
  Description of Artificial Sequence: Synthetic oligonucleotide
  modified_base (20)..(21): a, c, g, u, unknown or other
uggggaagggcauuugaagnn

SEQ ID NO: 3689 - RNA, 21 nt, Artificial Sequence
  Description of Artificial Sequence: Synthetic oligonucleotide
  modified_base (20)..(21): a, c, g, u, unknown or other
cuggggaagggcauuugaann

SEQ ID NO: 3690 - RNA, 21 nt, Artificial Sequence
  Description of Artificial Sequence: Synthetic oligonucleotide
  modified_base (20)..(21): a, c, g, u, unknown or other
ucuggggaagggcauuugann

SEQ ID NO: 3691 - RNA, 21 nt, Artificial Sequence
  Description of Artificial Sequence: Synthetic oligonucleotide
  modified_base (20)..(21): a, c, g, u, unknown or other
cucuggggaagggcauuugnn

SEQ ID NO: 3692 - RNA, 21 nt, Artificial Sequence
  Description of Artificial Sequence: Synthetic oligonucleotide
  modified_base (20)..(21): a, c, g, u, unknown or other
agcuccuccaggcuggcagnn

SEQ ID NO: 3693 - RNA, 21 nt, Artificial Sequence
  Description of Artificial Sequence: Synthetic oligonucleotide
  modified_base (20)..(21): a, c, g, u, unknown or other
gagcuccuccaggcuggcann

SEQ ID NO: 3694 - RNA, 21 nt, Artificial Sequence
  Description of Artificial Sequence: Synthetic oligonucleotide
  modified_base (20)..(21): a, c, g, u, unknown or other
ggagcuccuccaggcuggcnn

SEQ ID NO: 3695 - RNA, 21 nt, Artificial Sequence
  Description of Artificial Sequence: Synthetic oligonucleotide
  modified_base (20)..(21): a, c, g, u, unknown or other
gggagcuccuccaggcuggnn

SEQ ID NO: 3696 - RNA, 21 nt, Artificial Sequence
  Description of Artificial Sequence: Synthetic oligonucleotide
  modified_base (20)..(21): a, c, g, u, unknown or other
ugggagcuccuccaggcugnn

SEQ ID NO: 3697 - RNA, 21 nt, Artificial Sequence
  Description of Artificial Sequence: Synthetic oligonucleotide
  modified_base (20)..(21): a, c, g, u, unknown or other
cugggagcuccuccaggcunn

SEQ ID NO: 3698 - RNA, 21 nt, Artificial Sequence
  Description of Artificial Sequence: Synthetic oligonucleotide
  modified_base (20)..(21): a, c, g, u, unknown or other
ucugggagcuccuccaggcnn

SEQ ID NO: 3699 - RNA, 21 nt, Artificial Sequence
  Description of Artificial Sequence: Synthetic oligonucleotide
  modified_base (20)..(21): a, c, g, u, unknown or other
cucugggagcuccuccaggnn

SEQ ID NO: 3700 - RNA, 21 nt, Artificial Sequence
  Description of Artificial Sequence: Synthetic oligonucleotide
  modified_base (20)..(21): a, c, g, u, unknown or other
ccucugggagcuccuccagnn

SEQ ID NO: 3701 - RNA, 21 nt, Artificial Sequence
  Description of Artificial Sequence: Synthetic oligonucleotide
  modified_base (20)..(21): a, c, g, u, unknown or other
accucugggagcuccuccann

SEQ ID NO: 3702 - RNA, 21 nt, Artificial Sequence
  Description of Artificial Sequence: Synthetic oligonucleotide
  modified_base (20)..(21): a, c, g, u, unknown or other
gaccucugggagcuccuccnn

SEQ ID NO: 3703 - RNA, 21 nt, Artificial Sequence
  Description of Artificial Sequence: Synthetic oligonucleotide
  modified_base (20)..(21): a, c, g, u, unknown or other
agaccucugggagcuccucnn

SEQ ID NO: 3704 - RNA, 21 nt, Artificial Sequence
  Description of Artificial Sequence: Synthetic oligonucleotide
  modified_base (20)..(21): a, c, g, u, unknown or other
uagaccucugggagcuccunn

SEQ ID NO: 3705 - RNA, 21 nt, Artificial Sequence
  Description of Artificial Sequence: Synthetic oligonucleotide
  modified_base (20)..(21): a, c, g, u, unknown or other
guagaccucugggagcuccnn

SEQ ID NO: 3706 - RNA, 21 nt, Artificial Sequence
  Description of Artificial Sequence: Synthetic oligonucleotide
  modified_base (20)..(21): a, c, g, u, unknown or other
gguagaccucugggagcucnn

SEQ ID NO: 3707 - RNA, 21 nt, Artificial Sequence
  Description of Artificial Sequence: Synthetic oligonucleotide
  modified_base (20)..(21): a, c, g, u, unknown or other
ggguagaccucugggagcunn

SEQ ID NO: 3708 - RNA, 21 nt, Artificial Sequence
  Description of Artificial Sequence: Synthetic oligonucleotide
  modified_base (20)..(21): a, c, g, u, unknown or other
uggguagaccucugggagcnn

SEQ ID NO: 3709 - RNA, 21 nt, Artificial Sequence
  Description of Artificial Sequence: Synthetic oligonucleotide
  modified_base (20)..(21): a, c, g, u, unknown or other
cuggguagaccucugggagnn

SEQ ID NO: 3710 - RNA, 21 nt, Artificial Sequence
  Description of Artificial Sequence: Synthetic oligonucleotide
  modified_base (20)..(21): a, c, g, u, unknown or other
ucuggguagaccucugggann

SEQ ID NO: 3711 - RNA, 21 nt, Artificial Sequence
  Description of Artificial Sequence: Synthetic oligonucleotide
  modified_base (20)..(21): a, c, g, u, unknown or other
uucuggguagaccucugggnn

SEQ ID NO: 3712 - RNA, 21 nt, Artificial Sequence
  Description of Artificial Sequence: Synthetic oligonucleotide
  modified_base (20)..(21): a, c, g, u, unknown or other
cuucuggguagaccucuggnn

SEQ ID NO: 3713 - RNA, 21 nt, Artificial Sequence
  Description of Artificial Sequence: Synthetic oligonucleotide
  modified_base (20)..(21): a, c, g, u, unknown or other
ccuucuggguagaccucugnn

SEQ ID NO: 3714 - RNA, 21 nt, Artificial Sequence
  Description of Artificial Sequence: Synthetic oligonucleotide
  modified_base (20)..(21): a, c, g, u, unknown or other
uccuucuggguagaccucunn

SEQ ID NO: 3715 - RNA, 21 nt, Artificial Sequence
  Description of Artificial Sequence: Synthetic oligonucleotide
  modified_base (20)..(21): a, c, g, u, unknown or other
guccuucuggguagaccucnn

SEQ ID NO: 3716 - RNA, 21 nt, Artificial Sequence
  Description of Artificial Sequence: Synthetic oligonucleotide
  modified_base (20)..(21): a, c, g, u, unknown or other
gguccuucuggguagaccunn

SEQ ID NO: 3717 - RNA, 21 nt, Artificial Sequence
  Description of Artificial Sequence: Synthetic oligonucleotide
  modified_base (20)..(21): a, c, g, u, unknown or other
ggguccuucuggguagaccnn

SEQ ID NO: 3718 - RNA, 21 nt, Artificial Sequence
  Description of Artificial Sequence: Synthetic oligonucleotide
  modified_base (20)..(21): a, c, g, u, unknown or other
uggguccuucuggguagacnn

SEQ ID NO: 3719 - RNA, 21 nt, Artificial Sequence
  Description of Artificial Sequence: Synthetic oligonucleotide
  modified_base (20)..(21): a, c, g, u, unknown or other
cuggguccuucuggguagann

SEQ ID NO: 3720 - RNA, 21 nt, Artificial Sequence
  Description of Artificial Sequence: Synthetic oligonucleotide
  modified_base (20)..(21): a, c, g, u, unknown or other
acuggguccuucuggguagnn

SEQ ID NO: 3721 - RNA, 21 nt, Artificial Sequence
  Description of Artificial Sequence: Synthetic oligonucleotide
  modified_base (20)..(21): a, c, g, u, unknown or other
aacuggguccuucuggguann

SEQ ID NO: 3722 - RNA, 21 nt, Artificial Sequence
  Description of Artificial Sequence: Synthetic oligonucleotide
  modified_base (20)..(21): a, c, g, u, unknown or other
gaacuggguccuucugggunn

SEQ ID NO: 3723 - RNA, 21 nt, Artificial Sequence
  Description of Artificial Sequence: Synthetic oligonucleotide
  modified_base (20)..(21): a, c, g, u, unknown or other
ggaacuggguccuucugggnn

SEQ ID NO: 3724 - RNA, 21 nt, Artificial Sequence
  Description of Artificial Sequence: Synthetic oligonucleotide
  modified_base (20)..(21): a, c, g, u, unknown or other
aggaacuggguccuucuggnn

SEQ ID NO: 3725 - RNA, 21 nt, Artificial Sequence
  Description of Artificial Sequence: Synthetic oligonucleotide
  modified_base (20)..(21): a, c, g, u, unknown or other
aaggaacuggguccuucugnn

SEQ ID NO: 3726 - RNA, 21 nt, Artificial Sequence
  Description of Artificial Sequence: Synthetic oligonucleotide
  modified_base (20)..(21): a, c, g, u, unknown or other
uaaggaacuggguccuucunn

SEQ ID NO: 3727 - RNA, 21 nt, Artificial Sequence
  Description of Artificial Sequence: Synthetic oligonucleotide
  modified_base (20)..(21): a, c, g, u, unknown or other
guaaggaacuggguccuucnn

SEQ ID NO: 3728 - RNA, 21 nt, Artificial Sequence
  Description of Artificial Sequence: Synthetic oligonucleotide
  modified_base (20)..(21): a, c, g, u, unknown or other
gguaaggaacuggguccuunn

SEQ ID NO: 3729 - RNA, 21 nt, Artificial Sequence
  Description of Artificial Sequence: Synthetic oligonucleotide
  modified_base (20)..(21): a, c, g, u, unknown or other
ugguaaggaacuggguccunn

SEQ ID NO: 3730 - RNA, 21 nt, Artificial Sequence
  Description of Artificial Sequence: Synthetic oligonucleotide
  modified_base (20)..(21): a, c, g, u, unknown or other
cugguaaggaacuggguccnn

SEQ ID NO: 3731 - RNA, 21 nt, Artificial Sequence
  Description of Artificial Sequence: Synthetic oligonucleotide
  modified_base (20)..(21): a, c, g, u, unknown or other
gcugguaaggaacugggucnn

SEQ ID NO: 3732 - RNA, 21 nt, Artificial Sequence
  Description of Artificial Sequence: Synthetic oligonucleotide
  modified_base (20)..(21): a, c, g, u, unknown or other
ggcugguaaggaacugggunn

SEQ ID NO: 3733 - RNA, 21 nt, Artificial Sequence
  Description of Artificial Sequence: Synthetic oligonucleotide
  modified_base (20)..(21): a, c, g, u, unknown or other
aggcugguaaggaacugggnn

SEQ ID NO: 3734 - RNA, 21 nt, Artificial Sequence
  Description of Artificial Sequence: Synthetic oligonucleotide
  modified_base (20)..(21): a, c, g, u, unknown or other
gaggcugguaaggaacuggnn

SEQ ID NO: 3735 - RNA, 21 nt, Artificial Sequence
  Description of Artificial Sequence: Synthetic oligonucleotide
  modified_base (20)..(21): a, c, g, u, unknown or other
ggaggcugguaaggaacugnn

SEQ ID NO: 3736 - RNA, 21 nt, Artificial Sequence
  Description of Artificial Sequence: Synthetic oligonucleotide
  modified_base (20)..(21): a, c, g, u, unknown or other
gggaggcugguaaggaacunn

SEQ ID NO: 3737 - RNA, 21 nt, Artificial Sequence
  Description of Artificial Sequence: Synthetic oligonucleotide
  modified_base (20)..(21): a, c, g, u, unknown or other
agggaggcugguaaggaacnn

SEQ ID NO: 3738 - RNA, 21 nt, Artificial Sequence
  Description of Artificial Sequence: Synthetic oligonucleotide
  modified_base (20)..(21): a, c, g, u, unknown or other
aagggaggcugguaaggaann

SEQ ID NO: 3739 - RNA, 21 nt, Artificial Sequence
  Description of Artificial Sequence: Synthetic oligonucleotide
  modified_base (20)..(21): a, c, g, u, unknown or other
aaagggaggcugguaaggann

SEQ ID NO: 3740 - RNA, 21 nt, Artificial Sequence
  Description of Artificial Sequence: Synthetic oligonucleotide
  modified_base (20)..(21): a, c, g, u, unknown or other
gaaagggaggcugguaaggnn

SEQ ID NO: 3741 - RNA, 21 nt, Artificial Sequence
  Description of Artificial Sequence: Synthetic oligonucleotide
  modified_base (20)..(21): a, c, g, u, unknown or other
agaaagggaggcugguaagnn

SEQ ID NO: 3742 - RNA, 21 nt, Artificial Sequence
  Description of Artificial Sequence: Synthetic oligonucleotide
  modified_base (20)..(21): a, c, g, u, unknown or other
gagaaagggaggcugguaann

SEQ ID NO: 3743 - RNA, 21 nt, Artificial Sequence
  Description of Artificial Sequence: Synthetic oligonucleotide
  modified_base (20)..(21): a, c, g, u, unknown or other
agagaaagggaggcugguann

SEQ ID NO: 3744 - RNA, 21 nt, Artificial Sequence
  Description of Artificial Sequence: Synthetic oligonucleotide
  modified_base (20)..(21): a, c, g, u, unknown or other
cagagaaagggaggcuggunn

SEQ ID NO: 3745 - RNA, 21 nt, Artificial Sequence
  Description of Artificial Sequence: Synthetic oligonucleotide
  modified_base (20)..(21): a, c, g, u, unknown or other
acagagaaagggaggcuggnn

SEQ ID NO: 3746 - RNA, 21 nt, Artificial Sequence
  Description of Artificial Sequence: Synthetic oligonucleotide
  modified_base (20)..(21): a, c, g, u, unknown or other
gacagagaaagggaggcugnn

SEQ ID NO: 3747 - RNA, 21 nt, Artificial Sequence
  Description of Artificial Sequence: Synthetic oligonucleotide
  modified_base (20)..(21): a, c, g, u, unknown or other
ugacagagaaagggaggcunn

SEQ ID NO: 3748 - RNA, 21 nt, Artificial Sequence
  Description of Artificial Sequence: Synthetic oligonucleotide
  modified_base (20)..(21): a, c, g, u, unknown or other
cugacagagaaagggaggcnn

SEQ ID NO: 3749 - RNA, 21 nt, Artificial Sequence
  Description of Artificial Sequence: Synthetic oligonucleotide
  modified_base (20)..(21): a, c, g, u, unknown or other
acugacagagaaagggaggnn

SEQ ID NO: 3750 - RNA, 21 nt, Artificial Sequence
  Description of Artificial Sequence: Synthetic oligonucleotide
  modified_base (20)..(21): a, c, g, u, unknown or other
cacugacagagaaagggagnn

SEQ ID NO: 3751 - RNA, 21 nt, Artificial Sequence
  Description of Artificial Sequence: Synthetic oligonucleotide
  modified_base (20)..(21): a, c, g, u, unknown or other
ccacugacagagaaagggann

SEQ ID NO: 3752 - RNA, 21 nt, Artificial Sequence
  Description of Artificial Sequence: Synthetic oligonucleotide
  modified_base (20)..(21): a, c, g, u, unknown or other
cccacugacagagaaagggnn

SEQ ID NO: 3753 - RNA, 21 nt, Artificial Sequence
  Description of Artificial Sequence: Synthetic oligonucleotide
  modified_base (20)..(21): a, c, g, u, unknown or other
ccccacugacagagaaaggnn

SEQ ID NO: 3754 - RNA, 21 nt, Artificial Sequence
  Description of Artificial Sequence: Synthetic oligonucleotide
  modified_base (20)..(21): a, c, g, u, unknown or other
uccccacugacagagaaagnn

SEQ ID NO: 3755 - RNA, 21 nt, Artificial Sequence
  Description of Artificial Sequence: Synthetic oligonucleotide
  modified_base (20)..(21): a, c, g, u, unknown or other
guccccacugacagagaaann

SEQ ID NO: 3756 - RNA, 21 nt, Artificial Sequence
  Description of Artificial Sequence: Synthetic oligonucleotide
  modified_base (20)..(21): a, c, g, u, unknown or other
cguccccacugacagagaann

SEQ ID NO: 3757 - RNA, 21 nt, Artificial Sequence
  Description of Artificial Sequence: Synthetic oligonucleotide
  modified_base (20)..(21): a, c, g, u, unknown or other
acguccccacugacagagann

SEQ ID NO: 3758 - RNA, 21 nt, Artificial Sequence
  Description of Artificial Sequence: Synthetic oligonucleotide
  modified_base (20)..(21): a, c, g, u, unknown or other
gacguccccacugacagagnn

SEQ ID NO: 3759 - RNA, 21 nt, Artificial Sequence
  Description of Artificial Sequence: Synthetic oligonucleotide
  modified_base (20)..(21): a, c, g, u, unknown or other
ugacguccccacugacagann

SEQ ID NO: 3760 - RNA, 21 nt, Artificial Sequence
  Description of Artificial Sequence: Synthetic oligonucleotide
  modified_base (20)..(21): a, c, g, u, unknown or other
augacguccccacugacagnn

SEQ ID NO: 3761 - RNA, 21 nt, Artificial Sequence
  Description of Artificial Sequence: Synthetic oligonucleotide
  modified_base (20)..(21): a, c, g, u, unknown or other
gaugacguccccacugacann

SEQ ID NO: 3762 - RNA, 21 nt, Artificial Sequence
  Description of Artificial Sequence: Synthetic oligonucleotide
  modified_base (20)..(21): a, c, g, u, unknown or other
ugaugacguccccacugacnn

SEQ ID NO: 3763 - RNA, 21 nt, Artificial Sequence
  Description of Artificial Sequence: Synthetic oligonucleotide
  modified_base (20)..(21): a, c, g, u, unknown or other
cugaugacguccccacugann

SEQ ID NO: 3764 - RNA, 21 nt, Artificial Sequence
  Description of Artificial Sequence: Synthetic oligonucleotide
  modified_base (20)..(21): a, c, g, u, unknown or other
gcugaugacguccccacugnn

SEQ ID NO: 3765 - RNA, 21 nt, Artificial Sequence
  Description of Artificial Sequence: Synthetic oligonucleotide
  modified_base (20)..(21): a, c, g, u, unknown or other
ggcugaugacguccccacunn

SEQ ID NO: 3766 - RNA, 21 nt, Artificial Sequence
  Description of Artificial Sequence: Synthetic oligonucleotide
  modified_base (20)..(21): a, c, g, u, unknown or other
uggcugaugacguccccacnn

SEQ ID NO: 3767 - RNA, 21 nt, Artificial Sequence
  Description of Artificial Sequence: Synthetic oligonucleotide
  modified_base (20)..(21): a, c, g, u, unknown or other
uuggcugaugacguccccann

SEQ ID NO: 3768 - RNA, 21 nt, Artificial Sequence
  Description of Artificial Sequence: Synthetic oligonucleotide
  modified_base (20)..(21): a, c, g, u, unknown or other
cuuggcugaugacguccccnn

SEQ ID NO: 3769 - RNA, 21 nt, Artificial Sequence
  Description of Artificial Sequence: Synthetic oligonucleotide
  modified_base (20)..(21): a, c, g, u, unknown or other
gcuuggcugaugacgucccnn

SEQ ID NO: 3770 - RNA, 21 nt, Artificial Sequence
  Description of Artificial Sequence: Synthetic oligonucleotide
  modified_base (20)..(21): a, c, g, u, unknown or other
agcuuggcugaugacguccnn

SEQ ID NO: 3771 - RNA, 21 nt, Artificial Sequence
  Description of Artificial Sequence: Synthetic oligonucleotide
  modified_base (20)..(21): a, c, g, u, unknown or other
cagcuuggcugaugacgucnn

SEQ ID NO: 3772 - RNA, 21 nt, Artificial Sequence
  Description of Artificial Sequence: Synthetic oligonucleotide
  modified_base (20)..(21): a, c, g, u, unknown or other
ccagcuuggcugaugacgunn

SEQ ID NO: 3773 - RNA, 21 nt, Artificial Sequence
  Description of Artificial Sequence: Synthetic oligonucleotide
  modified_base (20)..(21): a, c, g, u, unknown or other
uccagcuuggcugaugacgnn

SEQ ID NO: 3774 - RNA, 21 nt, Artificial Sequence
  Description of Artificial Sequence: Synthetic oligonucleotide
  modified_base (20)..(21): a, c, g, u, unknown or other
uuccagcuuggcugaugacnn

SEQ ID NO: 3775 - RNA, 21 nt, Artificial Sequence
  Description of Artificial Sequence: Synthetic oligonucleotide
  modified_base (20)..(21): a, c, g, u, unknown or other
cuuccagcuuggcugaugann

SEQ ID NO: 3776 - RNA, 21 nt, Artificial Sequence
  Description of Artificial Sequence: Synthetic oligonucleotide
  modified_base (20)..(21): a, c, g, u, unknown or other
gcuuccagcuuggcugaugnn

SEQ ID NO: 3777 - RNA, 21 nt, Artificial Sequence
  Description of Artificial Sequence: Synthetic oligonucleotide
  modified_base (20)..(21): a, c, g, u, unknown or other
ggcuuccagcuuggcugaunn

SEQ ID NO: 3778 - RNA, 21 nt, Artificial Sequence
  Description of Artificial Sequence: Synthetic oligonucleotide
  modified_base (20)..(21): a, c, g, u, unknown or other
uggcuuccagcuuggcugann

SEQ ID NO: 3779 - RNA, 21 nt, Artificial Sequence
  Description of Artificial Sequence: Synthetic oligonucleotide
  modified_base (20)..(21): a, c, g, u, unknown or other
auggcuuccagcuuggcugnn

SEQ ID NO: 3780 - RNA, 21 nt, Artificial Sequence
  Description of Artificial Sequence: Synthetic oligonucleotide
  modified_base (20)..(21): a, c, g, u, unknown or other
aauggcuuccagcuuggcunn

SEQ ID NO: 3781 - RNA, 21 nt, Artificial Sequence
  Description of Artificial Sequence: Synthetic oligonucleotide
  modified_base (20)..(21): a, c, g, u, unknown or other
uaauggcuuccagcuuggcnn

SEQ ID NO: 3782 - RNA, 21 nt, Artificial Sequence
  Description of Artificial Sequence: Synthetic oligonucleotide
  modified_base (20)..(21): a, c, g, u, unknown or other
uuaauggcuuccagcuuggnn

SEQ ID NO: 3783 - RNA, 21 nt, Artificial Sequence
  Description of Artificial Sequence: Synthetic oligonucleotide
  modified_base (20)..(21): a, c, g, u, unknown or other
auuaauggcuuccagcuugnn

SEQ ID NO: 3784 - RNA, 21 nt, Artificial Sequence
  Description of Artificial Sequence: Synthetic oligonucleotide
  modified_base (20)..(21): a, c, g, u, unknown or other
cauuaauggcuuccagcuunn

SEQ ID NO: 3785 - RNA, 21 nt, Artificial Sequence
  Description of Artificial Sequence: Synthetic oligonucleotide
  modified_base (20)..(21): a, c, g, u, unknown or other
ucauuaauggcuuccagcunn

SEQ ID NO: 3786 - RNA, 21 nt, Artificial Sequence
  Description of Artificial Sequence: Synthetic oligonucleotide
  modified_base (20)..(21): a, c, g, u, unknown or other
uucauuaauggcuuccagcnn

SEQ ID NO: 3787 - RNA, 21 nt, Artificial Sequence
  Description of Artificial Sequence: Synthetic oligonucleotide
  modified_base (20)..(21): a, c, g, u, unknown or other
guucauuaauggcuuccagnn

SEQ ID NO: 3788 - RNA, 21 nt, Artificial Sequence
  Description of Artificial Sequence: Synthetic oligonucleotide
  modified_base (20)..(21): a, c, g, u, unknown or other
aguucauuaauggcuuccann

SEQ ID NO: 3789 - RNA, 21 nt, Artificial Sequence
  Description of Artificial Sequence: Synthetic oligonucleotide
  modified_base (20)..(21): a, c, g, u, unknown or other
uaguucauuaauggcuuccnn

SEQ ID NO: 3790 - RNA, 21 nt, Artificial Sequence
  Description of Artificial Sequence: Synthetic oligonucleotide
  modified_base (20)..(21): a, c, g, u, unknown or other
uuaguucauuaauggcuucnn

SEQ ID NO: 3791 - RNA, 21 nt, Artificial Sequence
  Description of Artificial Sequence: Synthetic oligonucleotide
  modified_base (20)..(21): a, c, g, u, unknown or other
auuaguucauuaauggcuunn

SEQ ID NO: 3792 - RNA, 21 nt, Artificial Sequence
  Description of Artificial Sequence: Synthetic oligonucleotide
  modified_base (20)..(21): a, c, g, u, unknown or other
aauuaguucauuaauggcunn

SEQ ID NO: 3793 - RNA, 21 nt, Artificial Sequence
  Description of Artificial Sequence: Synthetic oligonucleotide
  modified_base (20)..(21): a, c, g, u, unknown or other
gaauuaguucauuaauggcnn

SEQ ID NO: 3794 - RNA, 21 nt, Artificial Sequence
  Description of Artificial Sequence: Synthetic oligonucleotide
  modified_base (20)..(21): a, c, g, u, unknown or other
cgaauuaguucauuaauggnn

SEQ ID NO: 3795 - RNA, 21 nt, Artificial Sequence
  Description of Artificial Sequence: Synthetic oligonucleotide
  modified_base (20)..(21): a, c, g, u, unknown or other
acgaauuaguucauuaaugnn

SEQ ID NO: 3796 - RNA, 21 nt, Artificial Sequence
  Description of Artificial Sequence: Synthetic oligonucleotide
  modified_base (20)..(21): a, c, g, u, unknown or other
aacgaauuaguucauuaaunn

SEQ ID NO: 3797 - RNA, 21 nt, Artificial Sequence
  Description of Artificial Sequence: Synthetic oligonucleotide
  modified_base (20)..(21): a, c, g, u, unknown or other
aaacgaauuaguucauuaann

SEQ ID NO: 3798 - RNA, 21 nt, Artificial Sequence
  Description of Artificial Sequence: Synthetic oligonucleotide
  modified_base (20)..(21): a, c, g, u, unknown or other
aaaacgaauuaguucauuann

SEQ ID NO: 3799 - RNA, 21 nt, Artificial Sequence
  Description of Artificial Sequence: Synthetic oligonucleotide
  modified_base (20)..(21): a, c, g, u, unknown or other
caaaacgaauuaguucauunn

SEQ ID NO: 3800 - RNA, 21 nt, Artificial Sequence
  Description of Artificial Sequence: Synthetic oligonucleotide
  modified_base (20)..(21): a, c, g, u, unknown or other
ucaaaacgaauuaguucaunn

SEQ ID NO: 3801 - RNA, 21 nt, Artificial Sequence
  Description of Artificial Sequence: Synthetic oligonucleotide
  modified_base (20)..(21): a, c, g, u, unknown or other
gucaaaacgaauuaguucann

SEQ ID NO: 3802 - RNA, 21 nt, Artificial Sequence
  Description of Artificial Sequence: Synthetic oligonucleotide
  modified_base (20)..(21): a, c, g, u, unknown or other
ggucaaaacgaauuaguucnn

SEQ ID NO: 3803 - RNA, 21 nt, Artificial Sequence
  Description of Artificial Sequence: Synthetic oligonucleotide
  modified_base (20)..(21): a, c, g, u, unknown or other
uggucaaaacgaauuaguunn

SEQ ID NO: 3804 - RNA, 21 nt, Artificial Sequence
  Description of Artificial Sequence: Synthetic oligonucleotide
  modified_base (20)..(21): a, c, g, u, unknown or other
guggucaaaacgaauuagunn

SEQ ID NO: 3805 - RNA, 21 nt, Artificial Sequence
  Description of Artificial Sequence: Synthetic oligonucleotide
  modified_base (20)..(21): a, c, g, u, unknown or other
uguggucaaaacgaauuagnn

SEQ ID NO: 3806 - RNA, 21 nt, Artificial Sequence
  Description of Artificial Sequence: Synthetic oligonucleotide
  modified_base (20)..(21): a, c, g, u, unknown or other
auguggucaaaacgaauuann

SEQ ID NO: 3807 - RNA, 21 nt, Artificial Sequence
  Description of Artificial Sequence: Synthetic oligonucleotide
  modified_base (20)..(21): a, c, g, u, unknown or other
uauguggucaaaacgaauunn

SEQ ID NO: 3808 - RNA, 21 nt, Artificial Sequence
  Description of Artificial Sequence: Synthetic oligonucleotide
  modified_base (20)..(21): a, c, g, u, unknown or other
auauguggucaaaacgaaunn

SEQ ID NO: 3809 - RNA, 21 nt, Artificial Sequence
  Description of Artificial Sequence: Synthetic oligonucleotide
  modified_base (20)..(21): a, c, g, u, unknown or other
uauauguggucaaaacgaann

SEQ ID NO: 3810 - RNA, 21 nt, Artificial Sequence
  Description of Artificial Sequence: Synthetic oligonucleotide
  modified_base (20)..(21): a, c, g, u, unknown or other
auauauguggucaaaacgann

SEQ ID NO: 3811 - RNA, 21 nt, Artificial Sequence
  Description of Artificial Sequence: Synthetic oligonucleotide
  modified_base (20)..(21): a, c, g, u, unknown or other
uauauauguggucaaaacgnn

SEQ ID NO: 3812 - RNA, 21 nt, Artificial Sequence
  Description of Artificial Sequence: Synthetic oligonucleotide
  modified_base (20)..(21): a, c, g, u, unknown or other
guauauauguggucaaaacnn

SEQ ID NO: 3813 - RNA, 21 nt, Artificial Sequence
  Description of Artificial Sequence: Synthetic oligonucleotide
  modified_base (20)..(21): a, c, g, u, unknown or other
gguauauauguggucaaaann

SEQ ID NO: 3814 - RNA, 21 nt, Artificial Sequence
  Description of Artificial Sequence: Synthetic oligonucleotide
  modified_base (20)..(21): a, c, g, u, unknown or other
ugguauauauguggucaaann

SEQ ID NO: 3815 - RNA, 21 nt, Artificial Sequence
  Description of Artificial Sequence: Synthetic oligonucleotide
  modified_base (20)..(21): a, c, g, u, unknown or other
uugguauauauguggucaann

SEQ ID NO: 3816 - RNA, 21 nt, Artificial Sequence
  Description of Artificial Sequence: Synthetic oligonucleotide
  modified_base (20)..(21): a, c, g, u, unknown or other
cuugguauauauguggucann

SEQ ID NO: 3817 - RNA, 21 nt, Artificial Sequence
  Description of Artificial Sequence: Synthetic oligonucleotide
  modified_base (20)..(21): a, c, g, u, unknown or other
gcuugguauauauguggucnn

SEQ ID NO: 3818 - RNA, 21 nt, Artificial Sequence
  Description of Artificial Sequence: Synthetic oligonucleotide
  modified_base (20)..(21): a, c, g, u, unknown or other
ggcuugguauauauguggunn

SEQ ID NO: 3819 - RNA, 21 nt, Artificial Sequence
  Description of Artificial Sequence: Synthetic oligonucleotide
  modified_base (20)..(21): a, c, g, u, unknown or other
gggcuugguauauauguggnn

SEQ ID NO: 3820 - RNA, 21 nt, Artificial Sequence
  Description of Artificial Sequence: Synthetic oligonucleotide
  modified_base (20)..(21): a, c, g, u, unknown or other
ggggcuugguauauaugugnn

SEQ ID NO: 3821 - RNA, 21 nt, Artificial Sequence
  Description of Artificial Sequence: Synthetic oligonucleotide
  modified_base (20)..(21): a, c, g, u, unknown or other
aggggcuugguauauaugunn

SEQ ID NO: 3822 - RNA, 21 nt, Artificial Sequence
  Description of Artificial Sequence: Synthetic oligonucleotide
  modified_base (20)..(21): a, c, g, u, unknown or other
cagaggguaucucuaagacnn

SEQ ID NO: 3823 - RNA, 21 nt, Artificial Sequence
  Description of Artificial Sequence: Synthetic oligonucleotide
  modified_base (20)..(21): a, c, g, u, unknown or other
ucagaggguaucucuaagann

SEQ ID NO: 3824 - RNA, 21 nt, Artificial Sequence
  Description of Artificial Sequence: Synthetic oligonucleotide
  modified_base (20)..(21): a, c, g, u, unknown or other
cucagaggguaucucuaagnn

SEQ ID NO: 3825 - RNA, 21 nt, Artificial Sequence
  Description of Artificial Sequence: Synthetic oligonucleotide
  modified_base (20)..(21): a, c, g, u, unknown or other
ucucagaggguaucucuaann

SEQ ID NO: 3826 - RNA, 21 nt, Artificial Sequence
  Description of Artificial Sequence: Synthetic oligonucleotide
  modified_base (20)..(21): a, c, g, u, unknown or other
gucucagaggguaucucuann

SEQ ID NO: 3827 - RNA, 21 nt, Artificial Sequence
  Description of Artificial Sequence: Synthetic oligonucleotide
  modified_base (20)..(21): a, c, g, u, unknown or other
ugucucagaggguaucucunn

SEQ ID NO: 3828 - RNA, 21 nt, Artificial Sequence
  Description of Artificial Sequence: Synthetic oligonucleotide
  modified_base (20)..(21): a, c, g, u, unknown or other
cugucucagaggguaucucnn

SEQ ID NO: 3829 - RNA, 21 nt, Artificial Sequence
  Description of Artificial Sequence: Synthetic oligonucleotide
  modified_base (20)..(21): a, c, g, u, unknown or other
ucugucucagaggguaucunn

SEQ ID NO: 3830 - RNA, 21 nt, Artificial Sequence
  Description of Artificial Sequence: Synthetic oligonucleotide
  modified_base (20)..(21): a, c, g, u, unknown or other
cucugucucagaggguaucnn

SEQ ID NO: 3831 - RNA, 21 nt, Artificial Sequence
  Description of Artificial Sequence: Synthetic oligonucleotide
  modified_base (20)..(21): a, c, g, u, unknown or other
ucucugucucagaggguaunn

SEQ ID NO: 3832 - RNA, 21 nt, Artificial Sequence
  Description of Artificial Sequence: Synthetic oligonucleotide
  modified_base (20)..(21): a, c, g, u, unknown or other
cucucugucucagaggguann

SEQ ID NO: 3833 - RNA, 21 nt, Artificial Sequence
  Description of Artificial Sequence: Synthetic oligonucleotide
  modified_base (20)..(21): a, c, g, u, unknown or other
gcucucugucucagagggunn

SEQ ID NO: 3834 - RNA, 21 nt, Artificial Sequence
  Description of Artificial Sequence: Synthetic oligonucleotide
  modified_base (20)..(21): a, c, g, u, unknown or other
ggcucucugucucagagggnn

SEQ ID NO: 3835 - RNA, 21 nt, Artificial Sequence
  Description of Artificial Sequence: Synthetic oligonucleotide
  modified_base (20)..(21): a, c, g, u, unknown or other
uggcucucugucucagaggnn

SEQ ID NO: 3836 - RNA, 21 nt, Artificial Sequence
  Description of Artificial Sequence: Synthetic oligonucleotide
  modified_base (20)..(21): a, c, g, u, unknown or other
uuggcucucugucucagagnn

SEQ ID NO: 3837 - RNA, 21 nt, Artificial Sequence
  Description of Artificial Sequence: Synthetic oligonucleotide
  modified_base (20)..(21): a, c, g, u, unknown or other
cuuggcucucugucucagann

SEQ ID NO: 3838 - RNA, 21 nt, Artificial Sequence
  Description of Artificial Sequence: Synthetic oligonucleotide
  modified_base (20)..(21): a, c, g, u, unknown or other
gcuuggcucucugucucagnn

SEQ ID NO: 3839 - RNA, 21 nt, Artificial Sequence
  Description of Artificial Sequence: Synthetic oligonucleotide
  modified_base (20)..(21): a, c, g, u, unknown or other
agcuuggcucucugucucann

SEQ ID NO: 3840 - RNA, 21 nt, Artificial Sequence
  Description of Artificial Sequence: Synthetic oligonucleotide
  modified_base (20)..(21): a, c, g, u, unknown or other
uagcuuggcucucugucucnn

SEQ ID NO: 3841 - RNA, 21 nt, Artificial Sequence
  Description of Artificial Sequence: Synthetic oligonucleotide
  modified_base (20)..(21): a, c, g, u, unknown or other
uuagcuuggcucucugucunn

SEQ ID NO: 3842 - RNA, 21 nt, Artificial Sequence
  Description of Artificial Sequence: Synthetic oligonucleotide
  modified_base (20)..(21): a, c, g, u, unknown or other
auuagcuuggcucucugucnn

SEQ ID NO: 3843 - RNA, 21 nt, Artificial Sequence
  Description of Artificial Sequence: Synthetic oligonucleotide
  modified_base (20)..(21): a, c, g, u, unknown or other
cauuagcuuggcucucugunn

SEQ ID NO: 3844 - RNA, 21 nt, Artificial Sequence
  Description of Artificial Sequence: Synthetic oligonucleotide
  modified_base (20)..(21): a, c, g, u, unknown or other
acauuagcuuggcucucugnn

SEQ ID NO: 3845 - RNA, 21 nt, Artificial Sequence
  Description of Artificial Sequence: Synthetic oligonucleotide
  modified_base (20)..(21): a, c, g, u, unknown or other
cacauuagcuuggcucucunn

SEQ ID NO: 3846 - RNA, 21 nt, Artificial Sequence
  Description of Artificial Sequence: Synthetic oligonucleotide
  modified_base (20)..(21): a, c, g, u, unknown or other
ccacauuagcuuggcucucnn

SEQ ID NO: 3847 - RNA, 21 nt, Artificial Sequence
  Description of Artificial Sequence: Synthetic oligonucleotide
  modified_base (20)..(21): a, c, g, u, unknown or other
accacauuagcuuggcucunn

SEQ ID NO: 3848 - RNA, 21 nt, Artificial Sequence
  Description of Artificial Sequence: Synthetic oligonucleotide
  modified_base (20)..(21): a, c, g, u, unknown or other
uaccacauuagcuuggcucnn

SEQ ID NO: 3849 - RNA, 21 nt, Artificial Sequence
  Description of Artificial Sequence: Synthetic oligonucleotide
  modified_base (20)..(21): a, c, g, u, unknown or other
cuaccacauuagcuuggcunn

SEQ ID NO: 3850 - RNA, 21 nt, Artificial Sequence
  Description of Artificial Sequence: Synthetic oligonucleotide
  modified_base (20)..(21): a, c, g, u, unknown or other
acuaccacauuagcuuggcnn

SEQ ID NO: 3851 - RNA, 21 nt, Artificial Sequence
  Description of Artificial Sequence: Synthetic oligonucleotide
  modified_base (20)..(21): a, c, g, u, unknown or other
cacuaccacauuagcuuggnn

SEQ ID NO: 3852 - RNA, 21 nt, Artificial Sequence
  Description of Artificial Sequence: Synthetic oligonucleotide
  modified_base (20)..(21): a, c, g, u, unknown or other
ucacuaccacauuagcuugnn

SEQ ID NO: 3853 - RNA, 21 nt, Artificial Sequence
  Description of Artificial Sequence: Synthetic oligonucleotide
  modified_base (20)..(21): a, c, g, u, unknown or other
uucacuaccacauuagcuunn

SEQ ID NO: 3854 - RNA, 21 nt, Artificial Sequence
  Description of Artificial Sequence: Synthetic oligonucleotide
  modified_base (20)..(21): a, c, g, u, unknown or other
uuucacuaccacauuagcunn

SEQ ID NO: 3855 - RNA, 21 nt, Artificial Sequence
  Description of Artificial Sequence: Synthetic oligonucleotide
  modified_base (20)..(21): a, c, g, u, unknown or other
uuuucacuaccacauuagcnn

SEQ ID NO: 3856 - RNA, 21 nt, Artificial Sequence
  Description of Artificial Sequence: Synthetic oligonucleotide
  modified_base (20)..(21): a, c, g, u, unknown or other
auuuucacuaccacauuagnn

SEQ ID NO: 3857 - RNA, 21 nt, Artificial Sequence
  Description of Artificial Sequence: Synthetic oligonucleotide
  modified_base (20)..(21): a, c, g, u, unknown or other
gauuuucacuaccacauuann

SEQ ID NO: 3858 - RNA, 21 nt, Artificial Sequence
  Description of Artificial Sequence: Synthetic oligonucleotide
  modified_base (20)..(21): a, c, g, u, unknown or other
cgauuuucacuaccacauunn

SEQ ID NO: 3859 - RNA, 21 nt, Artificial Sequence
  Description of Artificial Sequence: Synthetic oligonucleotide
  modified_base (20)..(21): a, c, g, u, unknown or other
ucgauuuucacuaccacaunn

SEQ ID NO: 3860 - RNA, 21 nt, Artificial Sequence
  Description of Artificial Sequence: Synthetic oligonucleotide
  modified_base (20)..(21): a, c, g, u, unknown or other
cucgauuuucacuaccacann

SEQ ID NO: 3861 - RNA, 21 nt, Artificial Sequence
  Description of Artificial Sequence: Synthetic oligonucleotide
  modified_base (20)..(21): a, c, g, u, unknown or other
ccucgauuuucacuaccacnn

SEQ ID NO: 3862 - RNA, 21 nt, Artificial Sequence
  Description of Artificial Sequence: Synthetic oligonucleotide
  modified_base (20)..(21): a, c, g, u, unknown or other
uccucgauuuucacuaccann

SEQ ID NO: 3863 - RNA, 21 nt, Artificial Sequence
  Description of Artificial Sequence: Synthetic oligonucleotide
  modified_base (20)..(21): a, c, g, u, unknown or other
uuccucgauuuucacuaccnn

SEQ ID NO: 3864 - RNA, 21 nt, Artificial Sequence
  Description of Artificial Sequence: Synthetic oligonucleotide
  modified_base (20)..(21): a, c, g, u, unknown or other
cuuccucgauuuucacuacnn

SEQ ID NO: 3865 - RNA, 21 nt, Artificial Sequence
  Description of Artificial Sequence: Synthetic oligonucleotide
  modified_base (20)..(21): a, c, g, u, unknown or other
gcuuccucgauuuucacuann

SEQ ID NO: 3866 - RNA, 21 nt, Artificial Sequence
  Description of Artificial Sequence: Synthetic oligonucleotide
  modified_base (20)..(21): a, c, g, u, unknown or other
ugcuuccucgauuuucacunn

SEQ ID NO: 3867 - RNA, 21 nt, Artificial Sequence
  Description of Artificial Sequence: Synthetic oligonucleotide
  modified_base (20)..(21): a, c, g, u, unknown or other
gugcuuccucgauuuucacnn

SEQ ID NO: 3868 - RNA, 21 nt, Artificial Sequence
  Description of Artificial Sequence: Synthetic oligonucleotide
  modified_base (20)..(21): a, c, g, u, unknown or other
ggugcuuccucgauuuucann

SEQ ID NO: 3869 - RNA, 21 nt, Artificial Sequence
  Description of Artificial Sequence: Synthetic oligonucleotide
  modified_base (20)..(21): a, c, g, u, unknown or other
aggugcuuccucgauuuucnn

SEQ ID NO: 3870 - RNA, 21 nt, Artificial Sequence
  Description of Artificial Sequence: Synthetic oligonucleotide
  modified_base (20)..(21): a, c, g, u, unknown or other
gaggugcuuccucgauuuunn

SEQ ID NO: 3871 - RNA, 21 nt, Artificial Sequence
  Description of Artificial Sequence: Synthetic oligonucleotide
  modified_base (20)..(21): a, c, g, u, unknown or other
agaggugcuuccucgauuunn

SEQ ID NO: 3872 - RNA, 21 nt, Artificial Sequence
  Description of Artificial Sequence: Synthetic oligonucleotide
  modified_base (20)..(21): a, c, g, u, unknown or other
gagaggugcuuccucgauunn

SEQ ID NO: 3873 - RNA, 21 nt, Artificial Sequence
  Description of Artificial Sequence: Synthetic oligonucleotide
  modified_base (20)..(21): a, c, g, u, unknown or other
ugagaggugcuuccucgaunn

SEQ ID NO: 3874 - RNA, 21 nt, Artificial Sequence
  Description of Artificial Sequence: Synthetic oligonucleotide
  modified_base (20)..(21): a, c, g, u, unknown or other
cugagaggugcuuccucgann

SEQ ID NO: 3875 - RNA, 21 nt, Artificial Sequence
  Description of Artificial Sequence: Synthetic oligonucleotide
  modified_base (20)..(21): a, c, g, u, unknown or other
gcugagaggugcuuccucgnn

SEQ ID NO: 3876 - RNA, 21 nt, Artificial Sequence
  Description of Artificial Sequence: Synthetic oligonucleotide
  modified_base (20)..(21): a, c, g, u, unknown or other
ggcugagaggugcuuccucnn

SEQ ID NO: 3877 - RNA, 21 nt, Artificial Sequence
  Description of Artificial Sequence: Synthetic oligonucleotide
  modified_base (20)..(21): a, c, g, u, unknown or other
gggcugagaggugcuuccunn

SEQ ID NO: 3878 - RNA, 21 nt, Artificial Sequence
  Description of Artificial Sequence: Synthetic oligonucleotide
  modified_base (20)..(21): a, c, g, u, unknown or other
ggggcugagaggugcuuccnn

SEQ ID NO: 3879 - RNA, 21 nt, Artificial Sequence
  Description of Artificial Sequence: Synthetic oligonucleotide
  modified_base (20)..(21): a, c, g, u, unknown or other
aggggcugagaggugcuucnn

SEQ ID NO: 3880 - RNA, 21 nt, Artificial Sequence
  Description of Artificial Sequence: Synthetic oligonucleotide
  modified_base (20)..(21): a, c, g, u, unknown or other
gaggggcugagaggugcuunn

SEQ ID NO: 3881 - RNA, 21 nt, Artificial Sequence
  Description of Artificial Sequence: Synthetic oligonucleotide
  modified_base (20)..(21): a, c, g, u, unknown or other
ugaggggcugagaggugcunn

SEQ ID NO: 3882 - RNA, 21 nt, Artificial Sequence
  Description of Artificial Sequence: Synthetic oligonucleotide
  modified_base (20)..(21): a, c, g, u, unknown or other
cugaggggcugagaggugcnn

SEQ ID NO: 3883 - RNA, 21 nt, Artificial Sequence
  Description of Artificial Sequence: Synthetic oligonucleotide
  modified_base (20)..(21): a, c, g, u, unknown or other
ucugaggggcugagaggugnn

SEQ ID NO: 3884 - RNA, 21 nt, Artificial Sequence
  Description of Artificial Sequence: Synthetic oligonucleotide
  modified_base (20)..(21): a, c, g, u, unknown or other
cucugaggggcugagaggunn

SEQ ID NO: 3885 - RNA, 21 nt, Artificial Sequence
  Description of Artificial Sequence: Synthetic oligonucleotide
  modified_base (20)..(21): a, c, g, u, unknown or other
ucucugaggggcugagaggnn

SEQ ID NO: 3886 - RNA, 21 nt, Artificial Sequence
  Description of Artificial Sequence: Synthetic oligonucleotide
  modified_base (20)..(21): a, c, g, u, unknown or other
uucucugaggggcugagagnn

SEQ ID NO: 3887 - RNA, 21 nt, Artificial Sequence
  Description of Artificial Sequence: Synthetic oligonucleotide
  modified_base (20)..(21): a, c, g, u, unknown or other
auucucugaggggcugagann

SEQ ID NO: 3888 - RNA, 21 nt, Artificial Sequence
  Description of Artificial Sequence: Synthetic oligonucleotide
  modified_base (20)..(21): a, c, g, u, unknown or other
cauucucugaggggcugagnn

SEQ ID NO: 3889 - RNA, 21 nt, Artificial Sequence
  Description of Artificial Sequence: Synthetic oligonucleotide
  modified_base (20)..(21): a, c, g, u, unknown or other
ucauucucugaggggcugann

SEQ ID NO: 3890 - RNA, 21 nt, Artificial Sequence
  Description of Artificial Sequence: Synthetic oligonucleotide
  modified_base (20)..(21): a, c, g, u, unknown or other
aucauucucugaggggcugnn

SEQ ID NO: 3891 - RNA, 21 nt, Artificial Sequence
  Description of Artificial Sequence: Synthetic oligonucleotide
  modified_base (20)..(21): a, c, g, u, unknown or other
gaucauucucugaggggcunn

SEQ ID NO: 3892 - RNA, 21 nt, Artificial Sequence
  Description of Artificial Sequence: Synthetic oligonucleotide
  modified_base (20)..(21): a, c, g, u, unknown or other
ugaucauucucugaggggcnn

SEQ ID NO: 3893 - RNA, 21 nt, Artificial Sequence
  Description of Artificial Sequence: Synthetic oligonucleotide
  modified_base (20)..(21): a, c, g, u, unknown or other
gugaucauucucugaggggnn

SEQ ID NO: 3894 - RNA, 21 nt, Artificial Sequence
  Description of Artificial Sequence: Synthetic oligonucleotide
  modified_base (20)..(21): a, c, g, u, unknown or other
ggugaucauucucugagggnn

SEQ ID NO: 3895 - RNA, 21 nt, Artificial Sequence
  Description of Artificial Sequence: Synthetic oligonucleotide
  modified_base (20)..(21): a, c, g, u, unknown or other
gggugaucauucucugaggnn

SEQ ID NO: 3896 - RNA, 21 nt, Artificial Sequence
  Description of Artificial Sequence: Synthetic oligonucleotide
  modified_base (20)..(21): a, c, g, u, unknown or other
agggugaucauucucugagnn

SEQ ID NO: 3897 - RNA, 21 nt, Artificial Sequence
  Description of Artificial Sequence: Synthetic oligonucleotide
  modified_base (20)..(21): a, c, g, u, unknown or other
cagggugaucauucucugann

SEQ ID NO: 3898 - RNA, 21 nt, Artificial Sequence
  Description of Artificial Sequence: Synthetic oligonucleotide
  modified_base (20)..(21): a, c, g, u, unknown or other
ucagggugaucauucucugnn

SEQ ID NO: 3899 - RNA, 21 nt, Artificial Sequence
  Description of Artificial Sequence: Synthetic oligonucleotide
  modified_base (20)..(21): a, c, g, u, unknown or other
uucagggugaucauucucunn

SEQ ID NO: 3900 - RNA, 21 nt, Artificial Sequence
  Description of Artificial Sequence: Synthetic oligonucleotide
  modified_base (20)..(21): a, c, g, u, unknown or other
auucagggugaucauucucnn

SEQ ID NO: 3901 - RNA, 21 nt, Artificial Sequence
  Description of Artificial Sequence: Synthetic oligonucleotide
  modified_base (20)..(21): a, c, g, u, unknown or other
aauucagggugaucauucunn

SEQ ID NO: 3902 - RNA, 21 nt, Artificial Sequence
  Description of Artificial Sequence: Synthetic oligonucleotide
  modified_base (20)..(21): a, c, g, u, unknown or other
gaauucagggugaucauucnn

SEQ ID NO: 3903 - RNA, 21 nt, Artificial Sequence
  Description of Artificial Sequence: Synthetic oligonucleotide
  modified_base (20)..(21): a, c, g, u, unknown or other
ugaauucagggugaucauunn

SEQ ID NO: 3904 - RNA, 21 nt, Artificial Sequence
  Description of Artificial Sequence: Synthetic oligonucleotide
  modified_base (20)..(21): a, c, g, u, unknown or other
augaauucagggugaucaunn

SEQ ID NO: 3905 - RNA, 21 nt, Artificial Sequence
  Description of Artificial Sequence: Synthetic oligonucleotide
  modified_base (20)..(21): a, c, g, u, unknown or other
aaugaauucagggugaucann

SEQ ID NO: 3906 - RNA, 21 nt, Artificial Sequence
  Description of Artificial Sequence: Synthetic oligonucleotide
  modified_base (20)..(21): a, c, g, u, unknown or other
caaugaauucagggugaucnn

SEQ ID NO: 3907 - RNA, 21 nt, Artificial Sequence
  Description of Artificial Sequence: Synthetic oligonucleotide
  modified_base (20)..(21): a, c, g, u, unknown or other
acaaugaauucagggugaunn

SEQ ID NO: 3908 - RNA, 21 nt, Artificial Sequence
  Description of Artificial Sequence: Synthetic oligonucleotide
  modified_base (20)..(21): a, c, g, u, unknown or other
gacaaugaauucagggugann

SEQ ID NO: 3909 - RNA, 21 nt, Artificial Sequence
  Description of Artificial Sequence: Synthetic oligonucleotide
  modified_base (20)..(21): a, c, g, u, unknown or other
agacaaugaauucagggugnn

SEQ ID NO: 3910 - RNA, 21 nt, Artificial Sequence
  Description of Artificial Sequence: Synthetic oligonucleotide
  modified_base (20)..(21): a, c, g, u, unknown or other
gagacaaugaauucagggunn

SEQ ID NO: 3911 - RNA, 21 nt, Artificial Sequence
  Description of Artificial Sequence: Synthetic oligonucleotide
  modified_base (20)..(21): a, c, g, u, unknown or other
ugagacaaugaauucagggnn

SEQ ID NO: 3912 - RNA, 21 nt, Artificial Sequence
  Description of Artificial Sequence: Synthetic oligonucleotide
  modified_base (20)..(21): a, c, g, u, unknown or other
cugagacaaugaauucaggnn

SEQ ID NO: 3913 - RNA, 21 nt, Artificial Sequence
  Description of Artificial Sequence: Synthetic oligonucleotide
  modified_base (20)..(21): a, c, g, u, unknown or other
acugagacaaugaauucagnn

SEQ ID NO: 3914 - RNA, 21 nt, Artificial Sequence
  Description of Artificial Sequence: Synthetic oligonucleotide
  modified_base (20)..(21): a, c, g, u, unknown or other
cacugagacaaugaauucann

SEQ ID NO: 3915 - RNA, 21 nt, Artificial Sequence
  Description of Artificial Sequence: Synthetic oligonucleotide
  modified_base (20)..(21): a, c, g, u, unknown or other
ucacugagacaaugaauucnn

SEQ ID NO: 3916 - RNA, 21 nt, Artificial Sequence
  Description of Artificial Sequence: Synthetic oligonucleotide
  modified_base (20)..(21): a, c, g, u, unknown or other
uucacugagacaaugaauunn

SEQ ID NO: 3917 - RNA, 21 nt, Artificial Sequence
  Description of Artificial Sequence: Synthetic oligonucleotide
  modified_base (20)..(21): a, c, g, u, unknown or other
cuucacugagacaaugaaunn

SEQ ID NO: 3918 - RNA, 21 nt, Artificial Sequence
  Description of Artificial Sequence: Synthetic oligonucleotide
  modified_base (20)..(21): a, c, g, u, unknown or other
ccuucacugagacaaugaann

SEQ ID NO: 3919 - RNA, 21 nt, Artificial Sequence
  Description of Artificial Sequence: Synthetic oligonucleotide
  modified_base (20)..(21): a, c, g, u, unknown or other
uccuucacugagacaaugann

SEQ ID NO: 3920 - RNA, 21 nt, Artificial Sequence
  Description of Artificial Sequence: Synthetic oligonucleotide
  modified_base (20)..(21): a, c, g, u, unknown or other
uuccuucacugagacaaugnn

SEQ ID NO: 3921 - RNA, 21 nt, Artificial Sequence
  Description of Artificial Sequence: Synthetic oligonucleotide
  modified_base (20)..(21): a, c, g, u, unknown or other
cuuccuucacugagacaaunn

SEQ ID NO: 3922 - RNA, 21 nt, Artificial Sequence
  Description of Artificial Sequence: Synthetic oligonucleotide
  modified_base (20)..(21): a, c, g, u, unknown or other
ucuuccuucacugagacaann

SEQ ID NO: 3923 - RNA, 21 nt, Artificial Sequence
  Description of Artificial Sequence: Synthetic oligonucleotide
  modified_base (20)..(21): a, c, g, u, unknown or other
uucuuccuucacugagacann

SEQ ID NO: 3924 - RNA, 21 nt, Artificial Sequence
  Description of Artificial Sequence: Synthetic oligonucleotide
  modified_base (20)..(21): a, c, g, u, unknown or other
guucuuccuucacugagacnn

SEQ ID NO: 3925 - RNA, 21 nt, Artificial Sequence
  Description of Artificial Sequence: Synthetic oligonucleotide
  modified_base (20)..(21): a, c, g, u, unknown or other
gguucuuccuucacugagann

SEQ ID NO: 3926 - RNA, 21 nt, Artificial Sequence
  Description of Artificial Sequence: Synthetic oligonucleotide
  modified_base (20)..(21): a, c, g, u, unknown or other
agguucuuccuucacugagnn

SEQ ID NO: 3927 - RNA, 21 nt, Artificial Sequence
  Description of Artificial Sequence: Synthetic oligonucleotide
  modified_base (20)..(21): a, c, g, u, unknown or other
cagguucuuccuucacugann

SEQ ID NO: 3928 - RNA, 21 nt, Artificial Sequence
  Description of Artificial Sequence: Synthetic oligonucleotide
  modified_base (20)..(21): a, c, g, u, unknown or other
acagguucuuccuucacugnn

SEQ ID NO: 3929 - RNA, 21 nt, Artificial Sequence
  Description of Artificial Sequence: Synthetic oligonucleotide
  modified_base (20)..(21): a, c, g, u, unknown or other
uacagguucuuccuucacunn

SEQ ID NO: 3930 - RNA, 21 nt, Artificial Sequence
  Description of Artificial Sequence: Synthetic oligonucleotide
  modified_base (20)..(21): a, c, g, u, unknown or other
cuacagguucuuccuucacnn

SEQ ID NO: 3931 - RNA, 21 nt, Artificial Sequence
  Description of Artificial Sequence: Synthetic oligonucleotide
  modified_base (20)..(21): a, c, g, u, unknown or other
ucuacagguucuuccuucann

SEQ ID NO: 3932 - RNA, 21 nt, Artificial Sequence
  Description of Artificial Sequence: Synthetic oligonucleotide
  modified_base (20)..(21): a, c, g, u, unknown or other
uucuacagguucuuccuucnn

SEQ ID NO: 3933 - RNA, 21 nt, Artificial Sequence
  Description of Artificial Sequence: Synthetic oligonucleotide
  modified_base (20)..(21): a, c, g, u, unknown or other
cuucuacagguucuuccuunn

SEQ ID NO: 3934 - RNA, 21 nt, Artificial Sequence
  Description of Artificial Sequence: Synthetic oligonucleotide
  modified_base (20)..(21): a, c, g, u, unknown or other
ucuucuacagguucuuccunn

SEQ ID NO: 3935 - RNA, 21 nt, Artificial Sequence
  Description of Artificial Sequence: Synthetic oligonucleotide
  modified_base (20)..(21): a, c, g, u, unknown or other
aucuucuacagguucuuccnn

SEQ ID NO: 3936 - RNA, 21 nt, Artificial Sequence
  Description of Artificial Sequence: Synthetic oligonucleotide
  modified_base (20)..(21): a, c, g, u, unknown or other
caucuucuacagguucuucnn

SEQ ID NO: 3937 - RNA, 21 nt, Artificial Sequence
  Description of Artificial Sequence: Synthetic oligonucleotide
  modified_base (20)..(21): a, c, g, u, unknown or other
ucaucuucuacagguucuunn

SEQ ID NO: 3938 - RNA, 21 nt, Artificial Sequence
  Description of Artificial Sequence: Synthetic oligonucleotide
  modified_base (20)..(21): a, c, g, u, unknown or other
gucaucuucuacagguucunn

SEQ ID NO: 3939 - RNA, 21 nt, Artificial Sequence
  Description of Artificial Sequence: Synthetic oligonucleotide
  modified_base (20)..(21): a, c, g, u, unknown or other
ggucaucuucuacagguucnn

SEQ ID NO: 3940 - RNA, 21 nt, Artificial Sequence
  Description of Artificial Sequence: Synthetic oligonucleotide
  modified_base (20)..(21): a, c, g, u, unknown or other
aggucaucuucuacagguunn

SEQ ID NO: 3941 - RNA, 21 nt, Artificial Sequence
  Description of Artificial Sequence: Synthetic oligonucleotide
  modified_base (20)..(21): a, c, g, u, unknown or other
gaggucaucuucuacaggunn

SEQ ID NO: 3942 - RNA, 21 nt, Artificial Sequence
  Description of Artificial Sequence: Synthetic oligonucleotide
  modified_base (20)..(21): a, c, g, u, unknown or other
agaaaacucacggccuugunn

SEQ ID NO: 3943 - RNA, 21 nt, Artificial Sequence
  Description of Artificial Sequence: Synthetic oligonucleotide
  modified_base (20)..(21): a, c, g, u, unknown or other
aacugaaaaacagaguagcnn

SEQ ID NO: 3944 - RNA, 21 nt, Artificial Sequence
  Description of Artificial Sequence: Synthetic oligonucleotide
  modified_base (20)..(21): a, c, g, u, unknown or other
gggucugcugaguccgcagnn

SEQ ID NO: 3945 - RNA, 21 nt, Artificial Sequence
  Description of Artificial Sequence: Synthetic oligonucleotide
  modified_base (20)..(21): a, c, g, u, unknown or other
aucacccugaauucauugunn

SEQ ID NO: 3946 - RNA, 21 nt, Artificial Sequence
  Description of Artificial Sequence: Synthetic oligonucleotide
  modified_base (20)..(21): a, c, g, u, unknown or other
cugaauucauugucucagunn

SEQ ID NO: 3947 - RNA, 21 nt, Artificial Sequence
  Description of Artificial Sequence: Synthetic oligonucleotide
  modified_base (20)..(21): a, c, g, u, unknown or other
cccagaggucuacccagaann

SEQ ID NO: 3948 - RNA, 21 nt, Artificial Sequence
  Description of Artificial Sequence: Synthetic oligonucleotide
  modified_base (20)..(21): a, c, g, u, unknown or other
aauucauugucucagugaann

SEQ ID NO: 3949 - RNA, 21 nt, Artificial Sequence
  Description of Artificial Sequence: Synthetic oligonucleotide
  modified_base (20)..(21): a, c, g, u, unknown or other
ugagaaccaggaguuaagann

SEQ ID NO: 3950 - RNA, 21 nt, Artificial Sequence
  Description of Artificial Sequence: Synthetic oligonucleotide
  modified_base (20)..(21): a, c, g, u, unknown or other
aagcuggaagccauuaaugnn

SEQ ID NO: 3951 - RNA, 21 nt, Artificial Sequence
  Description of Artificial Sequence: Synthetic oligonucleotide
  modified_base (20)..(21): a, c, g, u, unknown or other
ccccagcugauuagugucunn

SEQ ID NO: 3952 - RNA, 21 nt, Artificial Sequence
  Description of Artificial Sequence: Synthetic oligonucleotide
  modified_base (20)..(21): a, c, g, u, unknown or other
agcuggaagccauuaaugann

SEQ ID NO: 3953 - RNA, 21 nt, Artificial Sequence
  Description of Artificial Sequence: Synthetic oligonucleotide
  modified_base (20)..(21): a, c, g, u, unknown or other
cccugaauucauugucucann

SEQ ID NO: 3954 - RNA, 21 nt, Artificial Sequence
  Description of Artificial Sequence: Synthetic oligonucleotide
  modified_base (20)..(21): a, c, g, u, unknown or other
gcuggaagccauuaaugaann

SEQ ID NO: 3955 - RNA, 21 nt, Artificial Sequence
  Description of Artificial Sequence: Synthetic oligonucleotide
  modified_base (20)..(21): a, c, g, u, unknown or other
gugcaggcccaguugucacnn

SEQ ID NO: 3956 - RNA, 21 nt, Artificial Sequence
  Description of Artificial Sequence: Synthetic oligonucleotide
  modified_base (20)..(21): a, c, g, u, unknown or other
ccuuaccagccucccuuucnn

SEQ ID NO: 3957 - RNA, 21 nt, Artificial Sequence
  Description of Artificial Sequence: Synthetic oligonucleotide
  modified_base (20)..(21): a, c, g, u, unknown or other
ugaauucauugucucagugnn

SEQ ID NO: 3958 - RNA, 21 nt, Artificial Sequence
  Description of Artificial Sequence: Synthetic oligonucleotide
  modified_base (20)..(21): a, c, g, u, unknown or other
cccagcugauuagugucuann

SEQ ID NO: 3959 - RNA, 21 nt, Artificial Sequence
  Description of Artificial Sequence: Synthetic oligonucleotide
  modified_base (20)..(21): a, c, g, u, unknown or other
ccagcugauuagugucuaann

SEQ ID NO: 3960 - RNA, 21 nt, Artificial Sequence
  Description of Artificial Sequence: Synthetic oligonucleotide
  modified_base (20)..(21): a, c, g, u, unknown or other
acuauguaaaugcuugaugnn

SEQ ID NO: 3961 - RNA, 21 nt, Artificial Sequence
  Description of Artificial Sequence: Synthetic oligonucleotide
  modified_base (20)..(21): a, c, g, u, unknown or other
gagaaaacucacggccuugnn

SEQ ID NO: 3962 - RNA, 21 nt, Artificial Sequence
  Description of Artificial Sequence: Synthetic oligonucleotide
  modified_base (20)..(21): a, c, g, u, unknown or other
ccgggucugcugaguccgcnn

SEQ ID NO: 3963 - RNA, 21 nt, Artificial Sequence
  Description of Artificial Sequence: Synthetic oligonucleotide
  modified_base (20)..(21): a, c, g, u, unknown or other
acugaaaaacagaguagcann

SEQ ID NO: 3964 - RNA, 21 nt, Artificial Sequence
  Description of Artificial Sequence: Synthetic oligonucleotide
  modified_base (20)..(21): a, c, g, u, unknown or other
ugaaaaacagaguagcagcnn

SEQ ID NO: 3965 - RNA, 21 nt, Artificial Sequence
  Description of Artificial Sequence: Synthetic oligonucleotide
  modified_base (20)..(21): a, c, g, u, unknown or other
uugagaaccaggaguuaagnn

SEQ ID NO: 3966 - RNA, 21 nt, Artificial Sequence
  Description of Artificial Sequence: Synthetic oligonucleotide
  modified_base (20)..(21): a, c, g, u, unknown or other
ggccgggucugcugaguccnn

SEQ ID NO: 3967 - RNA, 21 nt, Artificial Sequence
  Description of Artificial Sequence: Synthetic oligonucleotide
  modified_base (20)..(21): a, c, g, u, unknown or other
cucccuuucucugucagugnn

SEQ ID NO: 3968 - RNA, 21 nt, Artificial Sequence
  Description of Artificial Sequence: Synthetic oligonucleotide
  modified_base (20)..(21): a, c, g, u, unknown or other
ucacccugaauucauugucnn

SEQ ID NO: 3969 - RNA, 21 nt, Artificial Sequence
  Description of Artificial Sequence: Synthetic oligonucleotide
  modified_base (20)..(21): a, c, g, u, unknown or other
cacccugaauucauugucunn

SEQ ID NO: 3970 - RNA, 21 nt, Artificial Sequence
  Description of Artificial Sequence: Synthetic oligonucleotide
  modified_base (20)..(21): a, c, g, u, unknown or other
cuuuugccaaugaacuuuunn

SEQ ID NO: 3971 - RNA, 21 nt, Artificial Sequence
  Description of Artificial Sequence: Synthetic oligonucleotide
  modified_base (20)..(21): a, c, g, u, unknown or other
aaauuuacuauguaaaugcnn

SEQ ID NO: 3972 - RNA, 21 nt, Artificial Sequence
  Description of Artificial Sequence: Synthetic oligonucleotide
  modified_base (20)..(21): a, c, g, u, unknown or other
auuuacuauguaaaugcuunn

SEQ ID NO: 3973 - RNA, 21 nt, Artificial Sequence
  Description of Artificial Sequence: Synthetic oligonucleotide
  modified_base (20)..(21): a, c, g, u, unknown or other
uacuauguaaaugcuugaunn

SEQ ID NO: 3974 - RNA, 21 nt, Artificial Sequence
  Description of Artificial Sequence: Synthetic oligonucleotide
  modified_base (20)..(21): a, c, g, u, unknown or other
cuauguaaaugcuugauggnn

SEQ ID NO: 3975 - RNA, 21 nt, Artificial Sequence
  Description of Artificial Sequence: Synthetic oligonucleotide
  modified_base (20)..(21): a, c, g, u, unknown or other
ccauuuauuuaaaacuaccnn

SEQ ID NO: 3976 - RNA, 21 nt, Artificial Sequence
  Description of Artificial Sequence: Synthetic oligonucleotide
  modified_base (20)..(21): a, c, g, u, unknown or other
cauuuauuuaaaacuacccnn

SEQ ID NO: 3977 - RNA, 21 nt, Artificial Sequence
  Description of Artificial Sequence: Synthetic oligonucleotide
  modified_base (20)..(21): a, c, g, u, unknown or other
cugaaaaacagaguagcagnn

SEQ ID NO: 3978 - RNA, 21 nt, Artificial Sequence
  Description of Artificial Sequence: Synthetic oligonucleotide
  modified_base (20)..(21): a, c, g, u, unknown or other
cuagaaaaucagcuuuuacnn

SEQ ID NO: 3979 - RNA, 21 nt, Artificial Sequence
  Description of Artificial Sequence: Synthetic oligonucleotide
  modified_base (20)..(21): a, c, g, u, unknown or other
uagaaaaucagcuuuuacgnn

SEQ ID NO: 3980 - RNA, 21 nt, Artificial Sequence
  Description of Artificial Sequence: Synthetic oligonucleotide
  modified_base (20)..(21): a, c, g, u, unknown or other
guggccgggucugcugagunn

SEQ ID NO: 3981 - RNA, 21 nt, Artificial Sequence
  Description of Artificial Sequence: Synthetic oligonucleotide
  modified_base (20)..(21): a, c, g, u, unknown or other
uggccgggucugcugagucnn

SEQ ID NO: 3982 - RNA, 21 nt, Artificial Sequence
  Description of Artificial Sequence: Synthetic oligonucleotide
  modified_base (20)..(21): a, c, g, u, unknown or other
gccgggucugcugaguccgnn

SEQ ID NO: 3983 - RNA, 21 nt, Artificial Sequence
  Description of Artificial Sequence: Synthetic oligonucleotide
  modified_base (20)..(21): a, c, g, u, unknown or other
ugcaggcccaguugucaccnn

SEQ ID NO: 3984 - RNA, 21 nt, Artificial Sequence
  Description of Artificial Sequence: Synthetic oligonucleotide
  modified_base (20)..(21): a, c, g, u, unknown or other
ccagaggucuacccagaagnn

SEQ ID NO: 3985 - RNA, 21 nt, Artificial Sequence
  Description of Artificial Sequence: Synthetic oligonucleotide
  modified_base (20)..(21): a, c, g, u, unknown or other
agaggucuacccagaaggann

SEQ ID NO: 3986 - RNA, 21 nt, Artificial Sequence
  Description of Artificial Sequence: Synthetic oligonucleotide
  modified_base (20)..(21): a, c, g, u, unknown or other
uccuuaccagccucccuuunn

SEQ ID NO: 3987 - RNA, 21 nt, Artificial Sequence
  Description of Artificial Sequence: Synthetic oligonucleotide
  modified_base (20)..(21): a, c, g, u, unknown or other
ucccuuucucugucaguggnn

SEQ ID NO: 3988 - RNA, 21 nt, Artificial Sequence
  Description of Artificial Sequence: Synthetic oligonucleotide
  modified_base (20)..(21): a, c, g, u, unknown or other
ccuuucucugucaguggggnn

SEQ ID NO: 3989 - RNA, 21 nt, Artificial Sequence
  Description of Artificial Sequence: Synthetic oligonucleotide
  modified_base (20)..(21): a, c, g, u, unknown or other
caucagccaagcuggaagcnn

SEQ ID NO: 3990 - RNA, 21 nt, Artificial Sequence
  Description of Artificial Sequence: Synthetic oligonucleotide
  modified_base (20)..(21): a, c, g, u, unknown or other
agccaagcuggaagccauunn

SEQ ID NO: 3991 - RNA, 21 nt, Artificial Sequence
  Description of Artificial Sequence: Synthetic oligonucleotide
  modified_base (20)..(21): a, c, g, u, unknown or other
gaucacccugaauucauugnn

SEQ ID NO: 3992 - RNA, 21 nt, Artificial Sequence
  Description of Artificial Sequence: Synthetic oligonucleotide
  modified_base (20)..(21): a, c, g, u, unknown or other
acccugaauucauugucucnn

SEQ ID NO: 3993 - RNA, 21 nt, Artificial Sequence
  Description of Artificial Sequence: Synthetic oligonucleotide
  modified_base (20)..(21): a, c, g, u, unknown or other
ccugaauucauugucucagnn

SEQ ID NO: 3994 - RNA, 21 nt, Artificial Sequence
  Description of Artificial Sequence: Synthetic oligonucleotide
  modified_base (20)..(21): a, c, g, u, unknown or other
gaauucauugucucagugann

SEQ ID NO: 3995 - RNA, 21 nt, Artificial Sequence
  Description of Artificial Sequence: Synthetic oligonucleotide
  modified_base (20)..(21): a, c, g, u, unknown or other
uauguaaaugcuugauggann

SEQ ID NO: 3996 - RNA, 21 nt, Artificial Sequence
  Description of Artificial Sequence: Synthetic oligonucleotide
  modified_base (20)..(21): a, c, g, u, unknown or other
gaggaaacugaaaaacagann

SEQ ID NO: 3997 - RNA, 21 nt, Artificial Sequence
  Description of Artificial Sequence: Synthetic oligonucleotide
  modified_base (20)..(21): a, c, g, u, unknown or other
aaacugaaaaacagaguagnn

SEQ ID NO: 3998 - RNA, 21 nt, Artificial Sequence
  Description of Artificial Sequence: Synthetic oligonucleotide
  modified_base (20)..(21): a, c, g, u, unknown or other
guuccuuaccagccucccunn

SEQ ID NO: 3999 - RNA, 21 nt, Artificial Sequence
  Description of Artificial Sequence: Synthetic oligonucleotide
  modified_base (20)..(21): a, c, g, u, unknown or other
uuccuuaccagccucccuunn

SEQ ID NO: 4000 - RNA, 21 nt, Artificial Sequence
  Description of Artificial Sequence: Synthetic oligonucleotide
  modified_base (20)..(21): a, c, g, u, unknown or other
cuuucucugucaguggggann

SEQ ID NO: 4001 - RNA, 21 nt, Artificial Sequence
  Description of Artificial Sequence: Synthetic oligonucleotide
  modified_base (20)..(21): a, c, g, u, unknown or other
ucaucagccaagcuggaagnn

SEQ ID NO: 4002 - RNA, 21 nt, Artificial Sequence
  Description of Artificial Sequence: Synthetic oligonucleotide
  modified_base (20)..(21): a, c, g, u, unknown or other
auucauugucucagugaagnn

SEQ ID NO: 4003 - RNA, 21 nt, Artificial Sequence
  Description of Artificial Sequence: Synthetic oligonucleotide
  modified_base (20)..(21): a, c, g, u, unknown or other
ggaaacugaaaaacagagunn

SEQ ID NO: 4004 - RNA, 21 nt, Artificial Sequence
  Description of Artificial Sequence: Synthetic oligonucleotide
  modified_base (20)..(21): a, c, g, u, unknown or other
gaaacugaaaaacagaguann

SEQ ID NO: 4005 - RNA, 21 nt, Artificial Sequence
  Description of Artificial Sequence: Synthetic oligonucleotide
  modified_base (20)..(21): a, c, g, u, unknown or other
gcuagaaaaucagcuuuuann

SEQ ID NO: 4006 - RNA, 21 nt, Artificial Sequence
  Description of Artificial Sequence: Synthetic oligonucleotide
  modified_base (20)..(21): a, c, g, u, unknown or other
cgggucugcugaguccgcann

SEQ ID NO: 4007 - RNA, 21 nt, Artificial Sequence
  Description of Artificial Sequence: Synthetic oligonucleotide
  modified_base (20)..(21): a, c, g, u, unknown or other
cucccagaggucuacccagnn

SEQ ID NO: 4008 - RNA, 21 nt, Artificial Sequence
  Description of Artificial Sequence: Synthetic oligonucleotide
  modified_base (20)..(21): a, c, g, u, unknown or other
uuuacuauguaaaugcuugnn

SEQ ID NO: 4009 - RNA, 21 nt, Artificial Sequence
  Description of Artificial Sequence: Synthetic oligonucleotide
  modified_base (20)..(21): a, c, g, u, unknown or other
uaccagccucccuuucucunn

SEQ ID NO: 4010 - RNA, 21 nt, Artificial Sequence
  Description of Artificial Sequence: Synthetic oligonucleotide
  modified_base (20)..(21): a, c, g, u, unknown or other
ccaagcuggaagccauuaann

SEQ ID NO: 4011 - RNA, 21 nt, Artificial Sequence
  Description of Artificial Sequence: Synthetic oligonucleotide
  modified_base (20)..(21): a, c, g, u, unknown or other
cuggaagccauuaaugaacnn

SEQ ID NO: 4012 - RNA, 21 nt, Artificial Sequence
  Description of Artificial Sequence: Synthetic oligonucleotide
  modified_base (20)..(21): a, c, g, u, unknown or other
uggaagccauuaaugaacunn

SEQ ID NO: 4013 - RNA, 21 nt, Artificial Sequence
  Description of Artificial Sequence: Synthetic oligonucleotide
  modified_base (20)..(21): a, c, g, u, unknown or other
uccauuuauuuaaaacuacnn

SEQ ID NO: 4014 - RNA, 21 nt, Artificial Sequence
  Description of Artificial Sequence: Synthetic oligonucleotide
  modified_base (20)..(21): a, c, g, u, unknown or other
cagaggucuacccagaaggnn

SEQ ID NO: 4015 - RNA, 21 nt, Artificial Sequence
  Description of Artificial Sequence: Synthetic oligonucleotide
  modified_base (20)..(21): a, c, g, u, unknown or other
uuacuauguaaaugcuugann

SEQ ID NO: 4016 - RNA, 21 nt, Artificial Sequence
  Description of Artificial Sequence: Synthetic oligonucleotide
  modified_base (20)..(21): a, c, g, u, unknown or other
aauuuacuauguaaaugcunn

SEQ ID NO: 4017 - RNA, 21 nt, Artificial Sequence
  Description of Artificial Sequence: Synthetic oligonucleotide
  modified_base (20)..(21): a, c, g, u, unknown or other
aucagccaagcuggaagccnn

SEQ ID NO: 4018 - RNA, 21 nt, Artificial Sequence
  Description of Artificial Sequence: Synthetic oligonucleotide
  modified_base (20)..(21): a, c, g, u, unknown or other
acuuuugccaaugaacuuunn

SEQ ID NO: 4019 - RNA, 21 nt, Artificial Sequence
  Description of Artificial Sequence: Synthetic oligonucleotide
  modified_base (20)..(21): a, c, g, u, unknown or other
guugagaaccaggaguuaann

SEQ ID NO: 4020 - RNA, 21 nt, Artificial Sequence
  Description of Artificial Sequence: Synthetic oligonucleotide
  modified_base (20)..(21): a, c, g, u, unknown or other
ucccagaggucuacccagann

SEQ ID NO: 4021 - RNA, 21 nt, Artificial Sequence
  Description of Artificial Sequence: Synthetic oligonucleotide
  modified_base (20)..(21): a, c, g, u, unknown or other
gaggucuacccagaaggacnn

SEQ ID NO: 4022 - RNA, 21 nt, Artificial Sequence
  Description of Artificial Sequence: Synthetic oligonucleotide
  modified_base (20)..(21): a, c, g, u, unknown or other
aggucuacccagaaggaccnn

SEQ ID NO: 4023 - RNA, 21 nt, Artificial Sequence
  Description of Artificial Sequence: Synthetic oligonucleotide
  modified_base (20)..(21): a, c, g, u, unknown or other
aguuccuuaccagccucccnn

SEQ ID NO: 4024 - RNA, 21 nt, Artificial Sequence
  Description of Artificial Sequence: Synthetic oligonucleotide
  modified_base (20)..(21): a, c, g, u, unknown or other
uuaccagccucccuuucucnn

SEQ ID NO: 4025 - RNA, 21 nt, Artificial Sequence
  Description of Artificial Sequence: Synthetic oligonucleotide
  modified_base (20)..(21): a, c, g, u, unknown or other
ccagccucccuuucucugunn

SEQ ID NO: 4026 - RNA, 21 nt, Artificial Sequence
  Description of Artificial Sequence: Synthetic oligonucleotide
  modified_base (20)..(21): a, c, g, u, unknown or other
agccucccuuucucugucann

SEQ ID NO: 4027 - RNA, 21 nt, Artificial Sequence
  Description of Artificial Sequence: Synthetic oligonucleotide
  modified_base (20)..(21): a, c, g, u, unknown or other
cccuuucucugucagugggnn

SEQ ID NO: 4028 - RNA, 21 nt, Artificial Sequence
  Description of Artificial Sequence: Synthetic oligonucleotide
  modified_base (20)..(21): a, c, g, u, unknown or other
ucagccaagcuggaagccann

SEQ ID NO: 4029 - RNA, 21 nt, Artificial Sequence
  Description of Artificial Sequence: Synthetic oligonucleotide
  modified_base (20)..(21): a, c, g, u, unknown or other
gccaagcuggaagccauuann

SEQ ID NO: 4030 - RNA, 21 nt, Artificial Sequence
  Description of Artificial Sequence: Synthetic oligonucleotide
  modified_base (20)..(21): a, c, g, u, unknown or other
caagcuggaagccauuaaunn

SEQ ID NO: 4031 - RNA, 21 nt, Artificial Sequence
  Description of Artificial Sequence: Synthetic oligonucleotide
  modified_base (20)..(21): a, c, g, u, unknown or other
ggaggaaacugaaaaacagnn

SEQ ID NO: 4032 - RNA, 21 nt, Artificial Sequence
  Description of Artificial Sequence: Synthetic oligonucleotide
  modified_base (20)..(21): a, c, g, u, unknown or other
aggaaacugaaaaacagagnn

SEQ ID NO: 4033 - RNA, 21 nt, Artificial Sequence
  Description of Artificial Sequence: Synthetic oligonucleotide
  modified_base (20)..(21): a, c, g, u, unknown or other
accagccucccuuucucugnn

SEQ ID NO: 4034 - RNA, 21 nt, Artificial Sequence
  Description of Artificial Sequence: Synthetic oligonucleotide
  modified_base (20)..(21): a, c, g, u, unknown or other
cagccucccuuucucugucnn

SEQ ID NO: 4035 - RNA, 21 nt, Artificial Sequence
  Description of Artificial Sequence: Synthetic oligonucleotide
  modified_base (20)..(21): a, c, g, u, unknown or other
gccucccuuucucugucagnn

SEQ ID NO: 4036 - RNA, 21 nt, Artificial Sequence
  Description of Artificial Sequence: Synthetic oligonucleotide
  modified_base (20)..(21): a, c, g, u, unknown or other
ccucccuuucucugucagunn

SEQ ID NO: 4037 - RNA, 21 nt, Artificial Sequence
  Description of Artificial Sequence: Synthetic oligonucleotide
  modified_base (20)..(21): a, c, g, u, unknown or other
uuucucugucaguggggacnn

SEQ ID NO: 4038 - RNA, 21 nt, Artificial Sequence
  Description of Artificial Sequence: Synthetic oligonucleotide
  modified_base (20)..(21): a, c, g, u, unknown or other
cagccaagcuggaagccaunn

SEQ ID NO: 4039 - RNA, 21 nt, Artificial Sequence
  Description of Artificial Sequence: Synthetic oligonucleotide
  modified_base (20)..(21): a, c, g, u, unknown or other
gcuaugguggugguggcagnn

SEQ ID NO: 4040 - RNA, 21 nt, Artificial Sequence
  Description of Artificial Sequence: Synthetic oligonucleotide
  modified_base (20)..(21): a, c, g, u, unknown or other
cuaugguggugguggcagcnn

SEQ ID NO: 4041 - RNA, 21 nt, Artificial Sequence
  Description of Artificial Sequence: Synthetic oligonucleotide
  modified_base (20)..(21): a, c, g, u, unknown or other
cuuaccagccucccuuucunn

SEQ ID NO: 4042 - RNA, 21 nt, Artificial Sequence
  Description of Artificial Sequence: Synthetic oligonucleotide
  modified_base (20)..(21): a, c, g, u, unknown or other
acaaggccgugaguuuucunn

SEQ ID NO: 4043 - RNA, 21 nt, Artificial Sequence
  Description of Artificial Sequence: Synthetic oligonucleotide
  modified_base (20)..(21): a, c, g, u, unknown or other
gcuacucuguuuuucaguunn

SEQ ID NO: 4044 - RNA, 21 nt, Artificial Sequence
  Description of Artificial Sequence: Synthetic oligonucleotide
  modified_base (20)..(21): a, c, g, u, unknown or other
cugcggacucagcagacccnn

SEQ ID NO: 4045 - RNA, 21 nt, Artificial Sequence
  Description of Artificial Sequence: Synthetic oligonucleotide
  modified_base (20)..(21): a, c, g, u, unknown or other
acaaugaauucagggugaunn

SEQ ID NO: 4046 - RNA, 21 nt, Artificial Sequence
  Description of Artificial Sequence: Synthetic oligonucleotide
  modified_base (20)..(21): a, c, g, u, unknown or other
acugagacaaugaauucagnn

SEQ ID NO: 4047 - RNA, 21 nt, Artificial Sequence
  Description of Artificial Sequence: Synthetic oligonucleotide
  modified_base (20)..(21): a, c, g, u, unknown or other
uucuggguagaccucugggnn

SEQ ID NO: 4048 - RNA, 21 nt, Artificial Sequence
  Description of Artificial Sequence: Synthetic oligonucleotide
  modified_base (20)..(21): a, c, g, u, unknown or other
uucacugagacaaugaauunn

SEQ ID NO: 4049 - RNA, 21 nt, Artificial Sequence
  Description of Artificial Sequence: Synthetic oligonucleotide
  modified_base (20)..(21): a, c, g, u, unknown or other
ucuuaacuccugguucucann

SEQ ID NO: 4050 - RNA, 21 nt, Artificial Sequence
  Description of Artificial Sequence: Synthetic oligonucleotide
  modified_base (20)..(21): a, c, g, u, unknown or other
cauuaauggcuuccagcuunn

SEQ ID NO: 4051 - RNA, 21 nt, Artificial Sequence
  Description of Artificial Sequence: Synthetic oligonucleotide
  modified_base (20)..(21): a, c, g, u, unknown or other
agacacuaaucagcuggggnn

SEQ ID NO: 4052 - RNA, 21 nt, Artificial Sequence
  Description of Artificial Sequence: Synthetic oligonucleotide
  modified_base (20)..(21): a, c, g, u, unknown or other
ucauuaauggcuuccagcunn

SEQ ID NO: 4053 - RNA, 21 nt, Artificial Sequence
  Description of Artificial Sequence: Synthetic oligonucleotide
  modified_base (20)..(21): a, c, g, u, unknown or other
ugagacaaugaauucagggnn

SEQ ID NO: 4054 - RNA, 21 nt, Artificial Sequence
  Description of Artificial Sequence: Synthetic oligonucleotide
  modified_base (20)..(21): a, c, g, u, unknown or other
uucauuaauggcuuccagcnn

SEQ ID NO: 4055 - RNA, 21 nt, Artificial Sequence
  Description of Artificial Sequence: Synthetic oligonucleotide
  modified_base (20)..(21): a, c, g, u, unknown or other
gugacaacugggccugcacnn

SEQ ID NO: 4056 - RNA, 21 nt, Artificial Sequence
  Description of Artificial Sequence: Synthetic oligonucleotide
  modified_base (20)..(21): a, c, g, u, unknown or other
gaaagggaggcugguaaggnn

SEQ ID NO: 4057 - RNA, 21 nt, Artificial Sequence
  Description of Artificial Sequence: Synthetic oligonucleotide
  modified_base (20)..(21): a, c, g, u, unknown or other
cacugagacaaugaauucann

SEQ ID NO: 4058 - RNA, 21 nt, Artificial Sequence
  Description of Artificial Sequence: Synthetic oligonucleotide
  modified_base (20)..(21): a, c, g, u, unknown or other
uagacacuaaucagcugggnn

SEQ ID NO: 4059 - RNA, 21 nt, Artificial Sequence
  Description of Artificial Sequence: Synthetic oligonucleotide
  modified_base (20)..(21): a, c, g, u, unknown or other
uuagacacuaaucagcuggnn

SEQ ID NO: 4060 - RNA, 21 nt, Artificial Sequence
  Description of Artificial Sequence: Synthetic oligonucleotide
  modified_base (20)..(21): a, c, g, u, unknown or other
caucaagcauuuacauagunn

SEQ ID NO: 4061 - RNA, 21 nt, Artificial Sequence
  Description of Artificial Sequence: Synthetic oligonucleotide
  modified_base (20)..(21): a, c, g, u, unknown or other
caaggccgugaguuuucucnn

SEQ ID NO: 4062 - RNA, 21 nt, Artificial Sequence
  Description of Artificial Sequence: Synthetic oligonucleotide
  modified_base (20)..(21): a, c, g, u, unknown or other
gcggacucagcagacccggnn

SEQ ID NO: 4063 - RNA, 21 nt, Artificial Sequence
  Description of Artificial Sequence: Synthetic oligonucleotide
  modified_base (20)..(21): a, c, g, u, unknown or other
ugcuacucuguuuuucagunn

SEQ ID NO: 4064 - RNA, 21 nt, Artificial Sequence
  Description of Artificial Sequence: Synthetic oligonucleotide
  modified_base (20)..(21): a, c, g, u, unknown or other
gcugcuacucuguuuuucann

SEQ ID NO: 4065 - RNA, 21 nt, Artificial Sequence
  Description of Artificial Sequence: Synthetic oligonucleotide
  modified_base (20)..(21): a, c, g, u, unknown or other
cuuaacuccugguucucaann

SEQ ID NO: 4066 - RNA, 21 nt, Artificial Sequence
  Description of Artificial Sequence: Synthetic oligonucleotide
  modified_base (20)..(21): a, c, g, u, unknown or other
ggacucagcagacccggccnn

SEQ ID NO: 4067 - RNA, 21 nt, Artificial Sequence
  Description of Artificial Sequence: Synthetic oligonucleotide
  modified_base (20)..(21): a, c, g, u, unknown or other
cacugacagagaaagggagnn

SEQ ID NO: 4068 - RNA, 21 nt, Artificial Sequence
  Description of Artificial Sequence: Synthetic oligonucleotide
  modified_base (20)..(21): a, c, g, u, unknown or other
gacaaugaauucagggugann

SEQ ID NO: 4069 - RNA, 21 nt, Artificial Sequence
  Description of Artificial Sequence: Synthetic oligonucleotide
  modified_base (20)..(21): a, c, g, u, unknown or other
agacaaugaauucagggugnn

SEQ ID NO: 4070 - RNA, 21 nt, Artificial Sequence
  Description of Artificial Sequence: Synthetic oligonucleotide
  modified_base (20)..(21): a, c, g, u, unknown or other
aaaaguucauuggcaaaagnn

SEQ ID NO: 4071 - RNA, 21 nt, Artificial Sequence
  Description of Artificial Sequence: Synthetic oligonucleotide
  modified_base (20)..(21): a, c, g, u, unknown or other
gcauuuacauaguaaauuunn

SEQ ID NO: 4072 - RNA, 21 nt, Artificial Sequence
  Description of Artificial Sequence: Synthetic oligonucleotide
  modified_base (20)..(21): a, c, g, u, unknown or other
aagcauuuacauaguaaaunn

SEQ ID NO: 4073 - RNA, 21 nt, Artificial Sequence
  Description of Artificial Sequence: Synthetic oligonucleotide
  modified_base (20)..(21): a, c, g, u, unknown or other
aucaagcauuuacauaguann

SEQ ID NO: 4074 - RNA, 21 nt, Artificial Sequence
  Description of Artificial Sequence: Synthetic oligonucleotide
  modified_base (20)..(21): a, c, g, u, unknown or other
ccaucaagcauuuacauagnn

SEQ ID NO: 4075 - RNA, 21 nt, Artificial Sequence
  Description of Artificial Sequence: Synthetic oligonucleotide
  modified_base (20)..(21): a, c, g, u, unknown or other
gguaguuuuaaauaaauggnn

SEQ ID NO: 4076 - RNA, 21 nt, Artificial Sequence
  Description of Artificial Sequence: Synthetic oligonucleotide
  modified_base (20)..(21): a, c, g, u, unknown or other
ggguaguuuuaaauaaaugnn

SEQ ID NO: 4077 - RNA, 21 nt, Artificial Sequence
  Description of Artificial Sequence: Synthetic oligonucleotide
  modified_base (20)..(21): a, c, g, u, unknown or other
cugcuacucuguuuuucagnn

SEQ ID NO: 4078 - RNA, 21 nt, Artificial Sequence
  Description of Artificial Sequence: Synthetic oligonucleotide
  modified_base (20)..(21): a, c, g, u, unknown or other
guaaaagcugauuuucuagnn

SEQ ID NO: 4079 - RNA, 21 nt, Artificial Sequence
  Description of Artificial Sequence: Synthetic oligonucleotide
  modified_base (20)..(21): a, c, g, u, unknown or other
cguaaaagcugauuuucuann

SEQ ID NO: 4080 - RNA, 21 nt, Artificial Sequence
  Description of Artificial Sequence: Synthetic oligonucleotide
  modified_base (20)..(21): a, c, g, u, unknown or other
acucagcagacccggccacnn

SEQ ID NO: 4081 - RNA, 21 nt, Artificial Sequence
  Description of Artificial Sequence: Synthetic oligonucleotide
  modified_base (20)..(21): a, c, g, u, unknown or other
gacucagcagacccggccann

SEQ ID NO: 4082 - RNA, 21 nt, Artificial Sequence
  Description of Artificial Sequence: Synthetic oligonucleotide
  modified_base (20)..(21): a, c, g, u, unknown or other
cggacucagcagacccggcnn

SEQ ID NO: 4083 - RNA, 21 nt, Artificial Sequence
  Description of Artificial Sequence: Synthetic oligonucleotide
  modified_base (20)..(21): a, c, g, u, unknown or other
ggugacaacugggccugcann

SEQ ID NO: 4084 - RNA, 21 nt, Artificial Sequence
  Description of Artificial Sequence: Synthetic oligonucleotide
  modified_base (20)..(21): a, c, g, u, unknown or other
cuucuggguagaccucuggnn

SEQ ID NO: 4085 - RNA, 21 nt, Artificial Sequence
  Description of Artificial Sequence: Synthetic oligonucleotide
  modified_base (20)..(21): a, c, g, u, unknown or other
uccuucuggguagaccucunn

SEQ ID NO: 4086 - RNA, 21 nt, Artificial Sequence
  Description of Artificial Sequence: Synthetic oligonucleotide
  modified_base (20)..(21): a, c, g, u, unknown or other
aaagggaggcugguaaggann

SEQ ID NO: 4087 - RNA, 21 nt, Artificial Sequence
  Description of Artificial Sequence: Synthetic oligonucleotide
  modified_base (20)..(21): a, c, g, u, unknown or other
ccacugacagagaaagggann

SEQ ID NO: 4088 - RNA, 21 nt, Artificial Sequence
  Description of Artificial Sequence: Synthetic oligonucleotide
  modified_base (20)..(21): a, c, g, u, unknown or other
ccccacugacagagaaaggnn

SEQ ID NO: 4089 - RNA, 21 nt, Artificial Sequence
  Description of Artificial Sequence: Synthetic oligonucleotide
  modified_base (20)..(21): a, c, g, u, unknown or other
gcuuccagcuuggcugaugnn

SEQ ID NO: 4090 - RNA, 21 nt, Artificial Sequence
  Description of Artificial Sequence: Synthetic oligonucleotide
  modified_base (20)..(21): a, c, g, u, unknown or other
aauggcuuccagcuuggcunn

SEQ ID NO: 4091 - RNA, 21 nt, Artificial Sequence
  Description of Artificial Sequence: Synthetic oligonucleotide
  modified_base (20)..(21): a, c, g, u, unknown or other
caaugaauucagggugaucnn

SEQ ID NO: 4092 - RNA, 21 nt, Artificial Sequence
  Description of Artificial Sequence: Synthetic oligonucleotide
  modified_base (20)..(21): a, c, g, u, unknown or other
gagacaaugaauucagggunn

SEQ ID NO: 4093 - RNA, 21 nt, Artificial Sequence
  Description of Artificial Sequence: Synthetic oligonucleotide
  modified_base (20)..(21): a, c, g, u, unknown or other
cugagacaaugaauucaggnn

SEQ ID NO: 4094 - RNA, 21 nt, Artificial Sequence
  Description of Artificial Sequence: Synthetic oligonucleotide
  modified_base (20)..(21): a, c, g, u, unknown or other
ucacugagacaaugaauucnn

SEQ ID NO: 4095 - RNA, 21 nt, Artificial Sequence
  Description of Artificial Sequence: Synthetic oligonucleotide
  modified_base (20)..(21): a, c, g, u, unknown or other
uccaucaagcauuuacauann

SEQ ID NO: 4096 - RNA, 21 nt, Artificial Sequence
  Description of Artificial Sequence: Synthetic oligonucleotide
  modified_base (20)..(21): a, c, g, u, unknown or other
ucuguuuuucaguuuccucnn

SEQ ID NO: 4097 - RNA, 21 nt, Artificial Sequence
  Description of Artificial Sequence: Synthetic oligonucleotide
  modified_base (20)..(21): a, c, g, u, unknown or other
cuacucuguuuuucaguuunn

SEQ ID NO: 4098 - RNA, 21 nt, Artificial Sequence
  Description of Artificial Sequence: Synthetic oligonucleotide
  modified_base (20)..(21): a, c, g, u, unknown or other
agggaggcugguaaggaacnn

SEQ ID NO: 4099 - RNA, 21 nt, Artificial Sequence
  Description of Artificial Sequence: Synthetic oligonucleotide
  modified_base (20)..(21): a, c, g, u, unknown or other
aagggaggcugguaaggaann

SEQ ID NO: 4100 - RNA, 21 nt, Artificial Sequence
  Description of Artificial Sequence: Synthetic oligonucleotide
  modified_base (20)..(21): a, c, g, u, unknown or other
uccccacugacagagaaagnn

SEQ ID NO: 4101 - RNA, 21 nt, Artificial Sequence
  Description of Artificial Sequence: Synthetic oligonucleotide
  modified_base (20)..(21): a, c, g, u, unknown or other
cuuccagcuuggcugaugann

SEQ ID NO: 4102 - RNA, 21 nt, Artificial Sequence
  Description of Artificial Sequence: Synthetic oligonucleotide
  modified_base (20)..(21): a, c, g, u, unknown or other
cuucacugagacaaugaaunn

SEQ ID NO: 4103 - RNA, 21 nt, Artificial Sequence
  Description of Artificial Sequence: Synthetic oligonucleotide
  modified_base (20)..(21): a, c, g, u, unknown or other
acucuguuuuucaguuuccnn

SEQ ID NO: 4104 - RNA, 21 nt, Artificial Sequence
  Description of Artificial Sequence: Synthetic oligonucleotide
  modified_base (20)..(21): a, c, g, u, unknown or other
uacucuguuuuucaguuucnn

SEQ ID NO: 4105 - RNA, 21 nt, Artificial Sequence
  Description of Artificial Sequence: Synthetic oligonucleotide
  modified_base (20)..(21): a, c, g, u, unknown or other
uaaaagcugauuuucuagcnn

SEQ ID NO: 4106 - RNA, 21 nt, Artificial Sequence
  Description of Artificial Sequence: Synthetic oligonucleotide
  modified_base (20)..(21): a, c, g, u, unknown or other
ugcggacucagcagacccgnn

SEQ ID NO: 4107 - RNA, 21 nt, Artificial Sequence
  Description of Artificial Sequence: Synthetic oligonucleotide
  modified_base (20)..(21): a, c, g, u, unknown or other
cuggguagaccucugggagnn

SEQ ID NO: 4108 - RNA, 21 nt, Artificial Sequence
  Description of Artificial Sequence: Synthetic oligonucleotide
  modified_base (20)..(21): a, c, g, u, unknown or other
caagcauuuacauaguaaann

SEQ ID NO: 4109 - RNA, 21 nt, Artificial Sequence
  Description of Artificial Sequence: Synthetic oligonucleotide
  modified_base (20)..(21): a, c, g, u, unknown or other
agagaaagggaggcugguann

SEQ ID NO: 4110 - RNA, 21 nt, Artificial Sequence
  Description of Artificial Sequence: Synthetic oligonucleotide
  modified_base (20)..(21): a, c, g, u, unknown or other
uuaauggcuuccagcuuggnn

SEQ ID NO: 4111 - RNA, 21 nt, Artificial Sequence
  Description of Artificial Sequence: Synthetic oligonucleotide
  modified_base (20)..(21): a, c, g, u, unknown or other
guucauuaauggcuuccagnn

SEQ ID NO: 4112 - RNA, 21 nt, Artificial Sequence
  Description of Artificial Sequence: Synthetic oligonucleotide
  modified_base (20)..(21): a, c, g, u, unknown or other
aguucauuaauggcuuccann

SEQ ID NO: 4113 - RNA, 21 nt, Artificial Sequence
  Description of Artificial Sequence: Synthetic oligonucleotide
  modified_base (20)..(21): a, c, g, u, unknown or other
guaguuuuaaauaaauggann

SEQ ID NO: 4114 - RNA, 21 nt, Artificial Sequence
  Description of Artificial Sequence: Synthetic oligonucleotide
  modified_base (20)..(21): a, c, g, u, unknown or other
ccuucuggguagaccucugnn

SEQ ID NO: 4115 - RNA, 21 nt, Artificial Sequence
  Description of Artificial Sequence: Synthetic oligonucleotide
  modified_base (20)..(21): a, c, g, u, unknown or other
ucaagcauuuacauaguaann

SEQ ID NO: 4116 - RNA, 21 nt, Artificial Sequence
  Description of Artificial Sequence: Synthetic oligonucleotide
  modified_base (20)..(21): a, c, g, u, unknown or other
agcauuuacauaguaaauunn

SEQ ID NO: 4117 - RNA, 21 nt, Artificial Sequence
  Description of Artificial Sequence: Synthetic oligonucleotide
  modified_base (20)..(21): a, c, g, u, unknown or other
ggcuuccagcuuggcugaunn

SEQ ID NO: 4118 - RNA, 21 nt, Artificial Sequence
  Description of Artificial Sequence: Synthetic oligonucleotide
  modified_base (20)..(21): a, c, g, u, unknown or other
aaaguucauuggcaaaagunn

SEQ ID NO: 4119 - RNA, 21 nt, Artificial Sequence
  Description of Artificial Sequence: Synthetic oligonucleotide
  modified_base (20)..(21): a, c, g, u, unknown or other
uuaacuccugguucucaacnn

SEQ ID NO: 4120 - RNA, 21 nt, Artificial Sequence
  Description of Artificial Sequence: Synthetic oligonucleotide
  modified_base (20)..(21): a, c, g, u, unknown or other
ucuggguagaccucugggann

SEQ ID NO: 4121 - RNA, 21 nt, Artificial Sequence
  Description of Artificial Sequence: Synthetic oligonucleotide
  modified_base (20)..(21): a, c, g, u, unknown or other
guccuucuggguagaccucnn

SEQ ID NO: 4122 - RNA, 21 nt, Artificial Sequence
  Description of Artificial Sequence: Synthetic oligonucleotide
  modified_base (20)..(21): a, c, g, u, unknown or other
gguccuucuggguagaccunn

SEQ ID NO: 4123 - RNA, 21 nt, Artificial Sequence
  Description of Artificial Sequence: Synthetic oligonucleotide
  modified_base (20)..(21): a, c, g, u, unknown or other
gggaggcugguaaggaacunn

SEQ ID NO: 4124 - RNA, 21 nt, Artificial Sequence
  Description of Artificial Sequence: Synthetic oligonucleotide
  modified_base (20)..(21): a, c, g, u, unknown or other
gagaaagggaggcugguaann

SEQ ID NO: 4125 - RNA, 21 nt, Artificial Sequence
  Description of Artificial Sequence: Synthetic oligonucleotide
  modified_base (20)..(21): a, c, g, u, unknown or other
acagagaaagggaggcuggnn

SEQ ID NO: 4126 - RNA, 21 nt, Artificial Sequence
  Description of Artificial Sequence: Synthetic oligonucleotide
  modified_base (20)..(21): a, c, g, u, unknown or other
ugacagagaaagggaggcunn

SEQ ID NO: 4127 - RNA, 21 nt, Artificial Sequence
  Description of Artificial Sequence: Synthetic oligonucleotide
  modified_base (20)..(21): a, c, g, u, unknown or other
cccacugacagagaaagggnn

SEQ ID NO: 4128 - RNA, 21 nt, Artificial Sequence
  Description of Artificial Sequence: Synthetic oligonucleotide
  modified_base (20)..(21): a, c, g, u, unknown or other
uggcuuccagcuuggcugann

SEQ ID NO: 4129 - RNA, 21 nt, Artificial Sequence
  Description of Artificial Sequence: Synthetic oligonucleotide
  modified_base (20)..(21): a, c, g, u, unknown or other
uaauggcuuccagcuuggcnn

SEQ ID NO: 4130 - RNA, 21 nt, Artificial Sequence
  Description of Artificial Sequence: Synthetic oligonucleotide
  modified_base (20)..(21): a, c, g, u, unknown or other
auuaauggcuuccagcuugnn

SEQ ID NO: 4131 - RNA, 21 nt, Artificial Sequence
  Description of Artificial Sequence: Synthetic oligonucleotide
  modified_base (20)..(21): a, c, g, u, unknown or other
cuguuuuucaguuuccuccnn

SEQ ID NO: 4132 - RNA, 21 nt, Artificial Sequence
  Description of Artificial Sequence: Synthetic oligonucleotide
  modified_base (20)..(21): a, c, g, u, unknown or other
cucuguuuuucaguuuccunn

SEQ ID NO: 4133 - RNA, 21 nt, Artificial Sequence
  Description of Artificial Sequence: Synthetic oligonucleotide
  modified_base (20)..(21): a, c, g, u, unknown or other
cagagaaagggaggcuggunn

SEQ ID NO: 4134 - RNA, 21 nt, Artificial Sequence
  Description of Artificial Sequence: Synthetic oligonucleotide
  modified_base (20)..(21): a, c, g, u, unknown or other
gacagagaaagggaggcugnn

SEQ ID NO: 4135 - RNA, 21 nt, Artificial Sequence
  Description of Artificial Sequence: Synthetic oligonucleotide
  modified_base (20)..(21): a, c, g, u, unknown or other
cugacagagaaagggaggcnn

SEQ ID NO: 4136 - RNA, 21 nt, Artificial Sequence
  Description of Artificial Sequence: Synthetic oligonucleotide
  modified_base (20)..(21): a, c, g, u, unknown or other
acugacagagaaagggaggnn

SEQ ID NO: 4137 - RNA, 21 nt, Artificial Sequence
  Description of Artificial Sequence: Synthetic oligonucleotide
  modified_base (20)..(21): a, c, g, u, unknown or other
guccccacugacagagaaann

SEQ ID NO: 4138 - RNA, 21 nt, Artificial Sequence
  Description of Artificial Sequence: Synthetic oligonucleotide
  modified_base (20)..(21): a, c, g, u, unknown or other
auggcuuccagcuuggcugnn

SEQ ID NO: 4139 - RNA, 21 nt, Artificial Sequence
  Description of Artificial Sequence: Synthetic oligonucleotide
  modified_base (20)..(21): a, c, g, u, unknown or other
cugccaccaccaccauagcnn

SEQ ID NO: 4140 - RNA, 21 nt, Artificial Sequence
  Description of Artificial Sequence: Synthetic oligonucleotide
  modified_base (20)..(21): a, c, g, u, unknown or other
gcugccaccaccaccauagnn

SEQ ID NO: 4141 - RNA, 21 nt, Artificial Sequence
  Description of Artificial Sequence: Synthetic oligonucleotide
  modified_base (20)..(21): a, c, g, u, unknown or other
agaaagggaggcugguaagnn

SEQ ID NO: 4142 - RNA, 19 nt, Artificial Sequence
  Description of Artificial Sequence: Synthetic oligonucleotide
uucuagaccuguuuugcuu

SEQ ID NO: 4143 - RNA, 19 nt, Artificial Sequence
  Description of Artificial Sequence: Synthetic oligonucleotide
uucuagaccuguuuugcuu

SEQ ID NO: 4144 - DNA, 21 bp, Artificial Sequence
  Description of Artificial Sequence: Synthetic oligonucleotide
  Description of Combined DNA/RNA Molecule: Synthetic oligonucleotide
uucuagaccuguuuugcuutt

SEQ ID NO: 4145 - RNA, 19 nt, Artificial Sequence
  Description of Artificial Sequence: Synthetic oligonucleotide
aagcaaaacaggucuagaa

SEQ ID NO: 4146 - DNA, 21 bp, Artificial Sequence
  Description of Artificial Sequence: Synthetic oligonucleotide
  Description of Combined DNA/RNA Molecule: Synthetic oligonucleotide
aagcaaaacaggucuagaatt

SEQ ID NO: 4147 - RNA, 19 nt, Artificial Sequence
  Description of Artificial Sequence: Synthetic oligonucleotide
gccuggaguuuauucggaa

SEQ ID NO: 4148 - RNA, 19 nt, Artificial Sequence
  Description of Artificial Sequence: Synthetic oligonucleotide
gccuggaguuuauucggaa

SEQ ID NO: 4149 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 4150 - RNA, 19 nt, Artificial Sequence
  Description of Artificial Sequence: Synthetic oligonucleotide
uuccgaauaaacuccaggc

SEQ ID NO: 4151 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 4152 - skipped

SEQ ID NO: 4153 - RNA, 19 nt, Artificial Sequence
  Description of Artificial Sequence: Synthetic oligonucleotide
cacccugaauucauugucu

SEQ ID NO: 4154 - RNA, 19 nt, Artificial Sequence
  Description of Artificial Sequence: Synthetic oligonucleotide
cacccugaauucauugucu

SEQ ID NO: 4155 - DNA, 21 bp, Artificial Sequence
  Description of Artificial Sequence: Synthetic oligonucleotide
  Description of Combined DNA/RNA Molecule: Synthetic oligonucleotide
cacccugaauucauugucutt

SEQ ID NO: 4156 - RNA, 19 nt, Artificial Sequence
  Description of Artificial Sequence: Synthetic oligonucleotide
agacaaugaauucagggug

SEQ ID NO: 4157 - DNA, 21 bp, Artificial Sequence
  Description of Artificial Sequence: Synthetic oligonucleotide
  Description of Combined DNA/RNA Molecule: Synthetic oligonucleotide
agacaaugaauucagggugtt

SEQ ID NO: 4158 - protein, 16 aa, Artificial Sequence
  Description of Artificial Sequence: Synthetic peptide
AAVALLPAVLLALLAP

SEQ ID NO: 4159 - protein, 11 aa, Artificial Sequence
  Description of Artificial Sequence: Synthetic peptide
AALLPVLLAAP

SEQ ID NO: 4160 - protein, 13 aa, Human immunodeficiency virus
GRKKRRQRRRPPQ

SEQ ID NO: 4161 - protein, 16 aa, Drosophila antennapedia
RQIKIWFQNRRMKWKK

SEQ ID NO: 4162 - DNA, 21 bp, Artificial Sequence
  Description of Artificial Sequence: Synthetic oligonucleotide
  Description of Combined DNA/RNA Molecule: Synthetic oligonucleotide
gccuggaguuuauucggaatt

SEQ ID NO: 4163 - DNA, 21 bp, Artificial Sequence
  Description of Artificial Sequence: Synthetic oligonucleotide
  Description of Combined DNA/RNA Molecule: Synthetic oligonucleotide
cacccugaauucauugucutt

SEQ ID NO: 4164 - DNA, 21 bp, Artificial Sequence
  Description of Artificial Sequence: Synthetic oligonucleotide
  Description of Combined DNA/RNA Molecule: Synthetic oligonucleotide
uuccgaauaaacuccaggctt

SEQ ID NO: 4165 - DNA, 21 bp, Artificial Sequence
  Description of Artificial Sequence: Synthetic oligonucleotide
  Description of Combined DNA/RNA Molecule: Synthetic oligonucleotide
agacaaugaauucagggugtt

SEQ ID NO: 4166 - DNA, 21 bp, Artificial Sequence
  Description of Artificial Sequence: Synthetic oligonucleotide
  Description of Combined DNA/RNA Molecule: Synthetic oligonucleotide
cccagcugauuagugucuatt

The invention claimed is:

1. A dual targeting siRNA agent comprising a first dsRNA targeting a PCSK9 gene, the first dsRNA comprising a first sense strand comprising the nucleotide sequence of SEQ ID NO:4148 and a first antisense strand comprising the nucleotide sequence of SEQ ID NO:4150, and a second dsRNA targeting a XBP-1 gene, the second dsRNA comprising a second sense strand comprising the nucleotide sequence of SEQ ID NO:4154 and a second strand comprising the nucleotide sequence of SEQ ID NO:4156 wherein the first dsRNA and the second dsRNA are linked with a covalent linker.

2. The dual targeting siRNA agent of claim 1, the first dsRNA consisting of AD-10792, the second dsRNA consisting of AD-18038, the covalent linker consisting of a disulfide Q51 linker and linking the first sense strand to the second sense strand.

3. The dual targeting siRNA agent of claim 1, wherein the first dsRNA comprises AD-10792.

4. The dual targeting siRNA agent of claim 1, wherein the second dsRNA comprises AD-18038.

5. The dual targeting siRNA agent of claim 1, wherein the first and second dsRNA each comprises at least one modified nucleotide.

6. The dual targeting siRNA agent of claim 5, wherein the modified nucleotide is chosen from the group of: a 2'-O-methyl modified nucleotide, a nucleotide comprising a 5'-phosphorothioate group, and a terminal nucleotide linked to a cholesteryl derivative or dodecanoic acid bisdecylamide group.

7. The dual targeting siRNA agent of claim 5, wherein the modified nucleotide is chosen from the group of: a 2'-deoxy-2'-fluoro modified nucleotide, a 2'-deoxy-modified nucleotide, a locked nucleotide, an abasic nucleotide, a 2'-amino-modified nucleotide, a 2'-alkyl-modified nucleotide, a morpholino nucleotide, a phosphoramidate, and a non-natural base comprising nucleotide.

8. The dual targeting siRNA agent of claim 1, wherein each strand of each dsRNA is 19-23 bases in length.

9. The dual targeting siRNA agent of claim 1, wherein the first and second dsRNAs are linked with a disulfide linker.

10. The dual targeting siRNA agent of claim 1, wherein the covalent linker links the sense strand of the first dsRNA to the sense strand of the second dsRNA.

11. The dual targeting siRNA agent of claim 1, wherein the covalent linker links the antisense strand of the first dsRNA to the antisense strand of the second dsRNA.

12. The dual targeting siRNA agent of claim 1, further comprising a ligand.

13. The dual targeting siRNA agent of claim 1, wherein administration of the dual targeting siRNA agent to a cell inhibits expression of the PCSK9 gene and the XBP-1 gene at a level equivalent to inhibition of expression of both genes obtained by the administration of each siRNA individually.

14. A pharmaceutical composition comprising the dual targeting siRNA agent of claim 1 and a pharmaceutical carrier.

15. The pharmaceutical composition of claim 14, wherein the pharmaceutical carrier is a lipid formulation.

16. A method of inhibiting expression of a PCSK9 gene and a XBP-1 gene in a cell, the method comprising (a) introducing into the cell the dual targeting siRNA agent of claim 1; and (b) maintaining the cell produced in step (a) for a time sufficient to obtain degradation of the mRNA transcript of the PCSK9 gene and the XBP-1 gene, thereby inhibiting expression of the PCSK9 gene and the XBP-1 gene in the cell.

17. The dual targeting siRNA agent of claim 2, further comprising a ligand.

18. A pharmaceutical composition comprising the dual targeting siRNA agent of claim 2 and a pharmaceutical carrier.

19. The pharmaceutical composition of claim 18, wherein the pharmaceutical carrier is a lipid formulation.

20. A method of inhibiting expression of a PCSK9 gene and a XBP-1 gene in a cell, the method comprising (a) introducing into the cell the dual targeting siRNA agent of claim 2; and (b) maintaining the cell produced in step (a) for a time sufficient to obtain degradation of the mRNA transcript of the PCSK9 gene and the XBP-1 gene, thereby inhibiting expression of the PCSK9 gene and the XBP-1 gene in the cell.

* * * * *